US012662543B2

(12) United States Patent
Wang et al.

(10) Patent No.: US 12,662,543 B2
(45) Date of Patent: Jun. 23, 2026

(54) ANTI-CD40 BINDING MOLECULES AND BI-SPECIFIC ANTIBODIES COMPRISING SUCH

(71) Applicant: LYVGEN BIOPHARMA HOLDINGS LIMITED, Grand Cayman (KY)

(72) Inventors: Jieyi Wang, Belmont, CA (US); Yi Wu, Shanghai (CN)

(73) Assignee: Lyvgen Biopharma Holdings Limited, Grand Cayman (KY)

( * ) Notice: Subject to any disclaimer, the term of this patent is extended or adjusted under 35 U.S.C. 154(b) by 994 days.

(21) Appl. No.: 17/771,367

(22) PCT Filed: Oct. 23, 2020

(86) PCT No.: PCT/US2020/057019
§ 371 (c)(1),
(2) Date: Apr. 22, 2022

(87) PCT Pub. No.: WO2021/081303
PCT Pub. Date: Apr. 29, 2021

(65) Prior Publication Data
US 2022/0372155 A1 Nov. 24, 2022

(30) Foreign Application Priority Data
Oct. 23, 2019 (WO) ................ PCT/CN2019/112809

(51) Int. Cl.
| | |
|---|---|
| *C07K 16/28* | (2006.01) |
| *A61P 35/00* | (2006.01) |
| *C07K 16/30* | (2006.01) |
| *C07K 16/32* | (2006.01) |
| *A61K 39/00* | (2006.01) |

(52) U.S. Cl.
CPC .......... *C07K 16/2878* (2013.01); *A61P 35/00* (2018.01); *C07K 16/2818* (2013.01); *C07K 16/2827* (2013.01); *C07K 16/3007* (2013.01); *C07K 16/32* (2013.01); *A61K 2039/505* (2013.01); *C07K 2317/24* (2013.01); *C07K 2317/31* (2013.01); *C07K 2317/41* (2013.01); *C07K 2317/52* (2013.01); *C07K 2317/565* (2013.01); *C07K 2317/567* (2013.01); *C07K 2317/622* (2013.01); *C07K 2317/75* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 7,193,064 B2 | 3/2007 | Mikayama et al. | |
| 9,234,044 B2 | 1/2016 | Matsushima et al. | |
| 2007/0148163 A1 | 6/2007 | Takahashi et al. | |
| 2008/0085531 A1 | 4/2008 | Den Hartog et al. | |
| 2012/0263732 A1 | 10/2012 | Gladue et al. | |
| 2012/0294796 A1 | 11/2012 | Johnson et al. | |
| 2014/0120103 A1 | 5/2014 | Zhang et al. | |
| 2016/0017040 A1 | 1/2016 | Leong et al. | |
| 2017/0253659 A1* | 9/2017 | Ravetch | C07K 16/2878 |
| 2018/0066053 A1 | 3/2018 | Keler et al. | |
| 2018/0346569 A1 | 12/2018 | Wang et al. | |
| 2019/0010233 A1 | 1/2019 | Liu et al. | |
| 2021/0253701 A1 | 8/2021 | Smith et al. | |
| 2024/0360218 A1 | 10/2024 | Campbell et al. | |

FOREIGN PATENT DOCUMENTS

| | | | |
|---|---|---|---|
| CN | 109912717 A | 6/2019 |
| WO | WO 2003/040170 A2 | 5/2003 |
| WO | WO 2007/066082 A1 | 6/2007 |
| WO | WO 2008/091954 A2 | 7/2008 |
| WO | 2011123489 A2 | 10/2011 |
| WO | WO 2013/034904 A1 | 3/2013 |
| WO | WO 2014/065402 A1 | 5/2014 |
| WO | WO 2016/028810 A1 | 2/2016 |
| WO | WO 2016/177771 A1 | 11/2016 |
| WO | 2016201389 A | 12/2016 |
| WO | WO 2017/004016 A1 | 1/2017 |
| WO | WO 2017/151176 A1 | 9/2017 |
| WO | WO 2017/205742 A1 | 11/2017 |
| WO | WO 2018/144955 A1 | 8/2018 |

(Continued)

OTHER PUBLICATIONS

Chen C, Roberts VA, Stevens S, Brown M, Stenzel-Poore MP, Rittenberg MB. Enhancement and destruction of antibody function by somatic mutation: unequal occurrence is controlled by V gene combinatorial associations. EMBO J. Jun. 15, 1995;14(12):2784-94. (Year: 1995).*

±U.S. Appl. No. 17/048,954, filed Oct. 19, 2020, Wang et al.

± U.S. Appl. No. 17/536,974, filed Nov. 29, 2021, Wang et al.

Björck et al. (2017) "APX005M is a Potent CD40 Agonistic Antibody Capable of Stimulating both Innate and Adaptive Immune Responses against Cancer", Journal for Immunotherapy of Cancer, 5(Suppl 2):P360, pp. 178.

Brown et al. (1996), "Tolerance of Single, but not Multiple, Amino Acid Replacements in Antibody VH CDR 2: A Means of Minimizing B Cell Wastage from Somatic Hypermutation?", Journal of Immunology, 156(9):3285-3291.

(Continued)

*Primary Examiner* — Joanne Hama
*Assistant Examiner* — Estella M. Gustilo
(74) *Attorney, Agent, or Firm* — Mintz, Levin, Cohn, Ferris, Glovsky and Popeo, P.C.

(57) ABSTRACT

Provided herein are antibodies (e.g., humanized antibodies) binding to CD40 and bi-specific antibodies comprising such for targeting both CD40 and a second suitable antigen such as a tumor antigen or an immune checkpoint molecule. Examples of the second antigen include PD-1, PD-L1, HER2, B7H3, B7H4, netrotic tumor cells (TNT), or CEA. Also provided herein are therapeutic uses of such antibodies.

22 Claims, 134 Drawing Sheets

Specification includes a Sequence Listing.

(56) References Cited

FOREIGN PATENT DOCUMENTS

| WO | 2019057792 A1 | 3/2019 |
| WO | WO 2019/204756 A1 | 10/2019 |
| WO | WO 2020/065409 A2 | 4/2020 |
| WO | 2021081303 A1 | 4/2021 |

OTHER PUBLICATIONS

Paul, William E. (1993) "Fundamental Immunology", Raven Press, 3rd edition, 292-295 (6 pages).
Rudikoff et al. (Mar. 1982) "Single Amino Acid Substitution Altering Antigen-Binding Specificity", Proceedings of the National Academy of Sciences, 79(6):1979-1983.
Vajdos et al. (Jul. 5, 2002) "Comprehensive Functional Maps of The Antigen-Binding Site of an Anti-ErbB2 Antibody Obtained with Shotgun Scanning Mutagenesis", Journal of Molecular Biology, 320(2):415-428.
[No Author Listed], GenBank Accession No. CAF28444.1. Jul. 26, 2016. 2 pages.
Li et al., Inhibitory Fcγ receptor engagement drives adjuvant and anti-tumor activities of agonistic CD40 antibodies. Science. Aug. 19, 2011;333(6045):1030-4.
Ma et al., Abstract 4936: Combination CD40 agonist and PD-1 antagonist antibody therapy enhances vaccine induced T cell responses in non-immunogenic cancers. Cancer Res. Jul. 1, 2018;78(13 Supplement):4936(1-2).
Bjorck et al., The CD40 agonistic monoclonal antibody APX005M has potent immune stimulatory capabilities. J Immuno Therapy Cancer. Nov. 4-8, 2015;3:P198.
Strohl, Optimization of Fc-mediated effector functions of monoclonal antibodies. Curr Opin Biotechnol. Dec. 2009;20(6):685-91. Epub Nov. 4, 2009.

* cited by examiner in solution with CHOK1-huPD-L1 in solution
Donor1 with CHOK1-huPD-L1
Donor1

FIG. 15C in solution
Donor2 with CHOK1-huPD-L1
Donor2 with CHOK1-huB7H4

FIG. 22E in solution with CHOK1-huB7H4

FIG. 22H with CHOK1-huB7H4

FIG. 22K with CHOK1-huB7H4

FIG. 26C
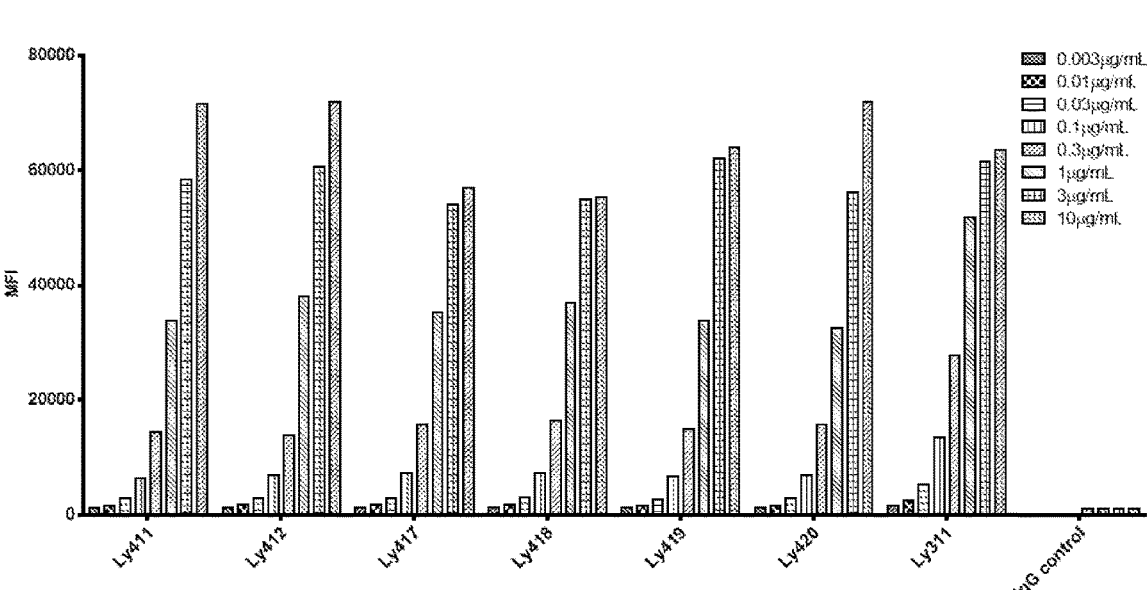
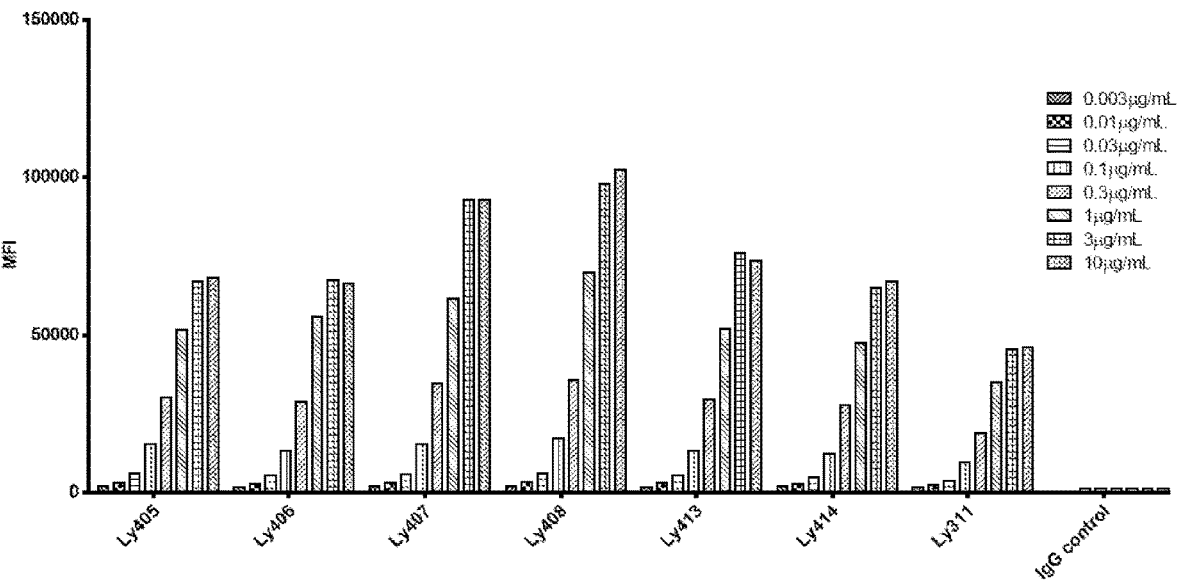
FIG. 26D

FIG. 27B
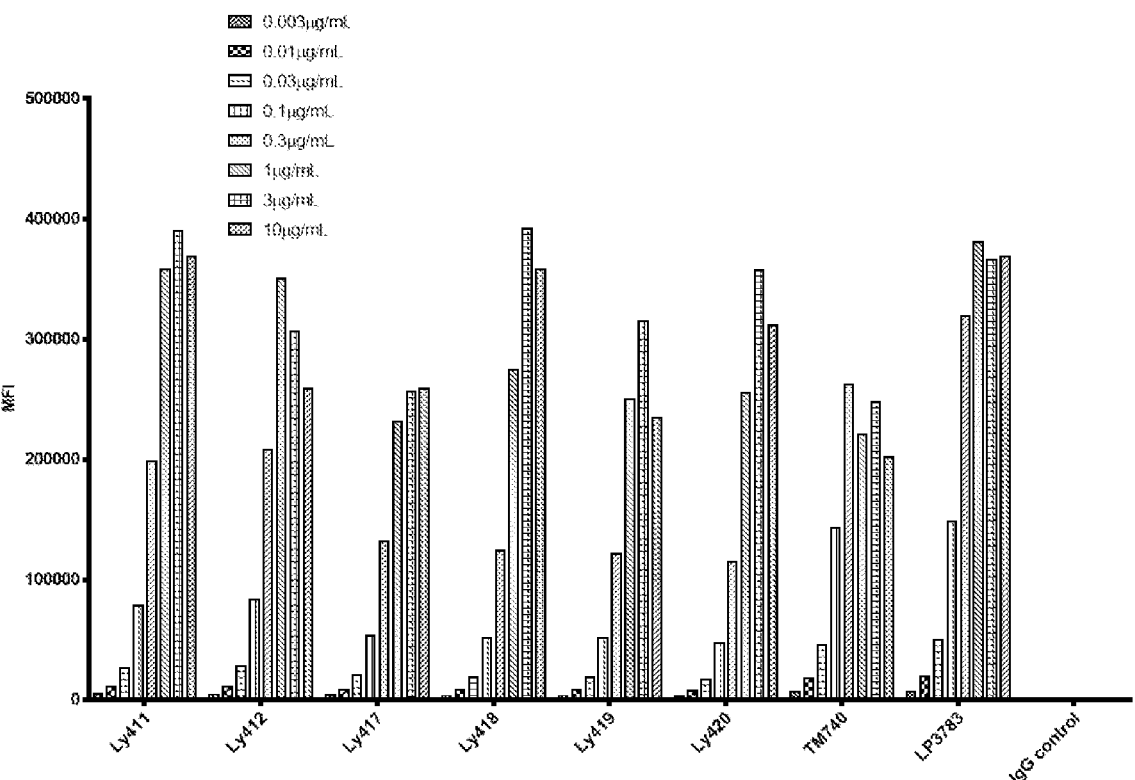
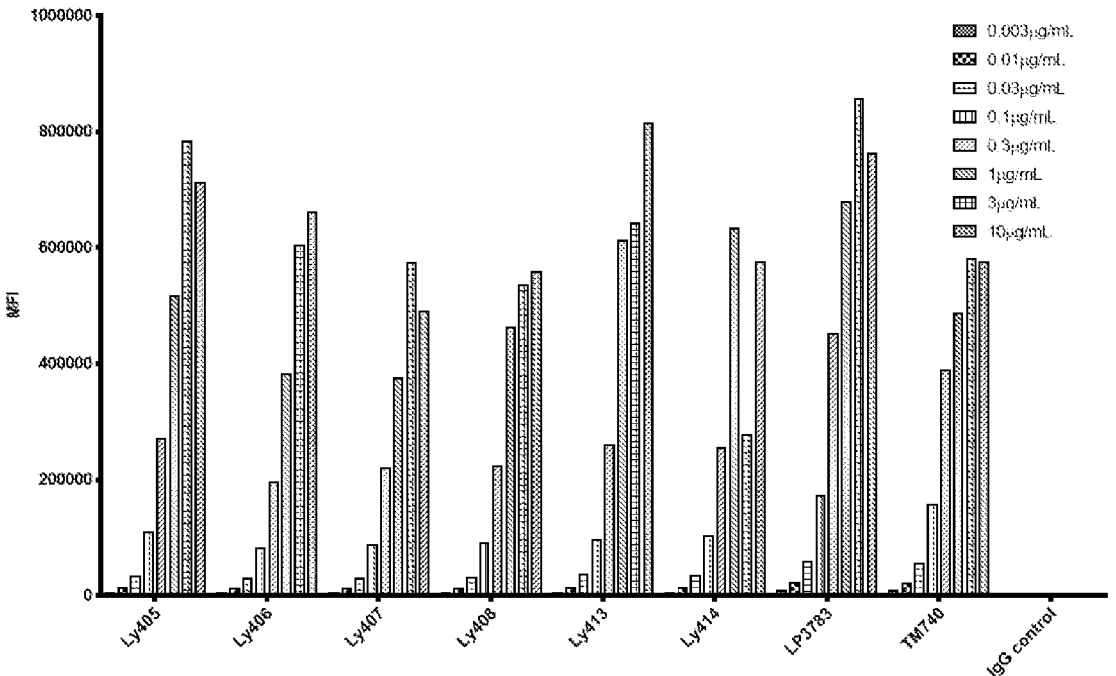
FIG. 27C

FIG. 27D
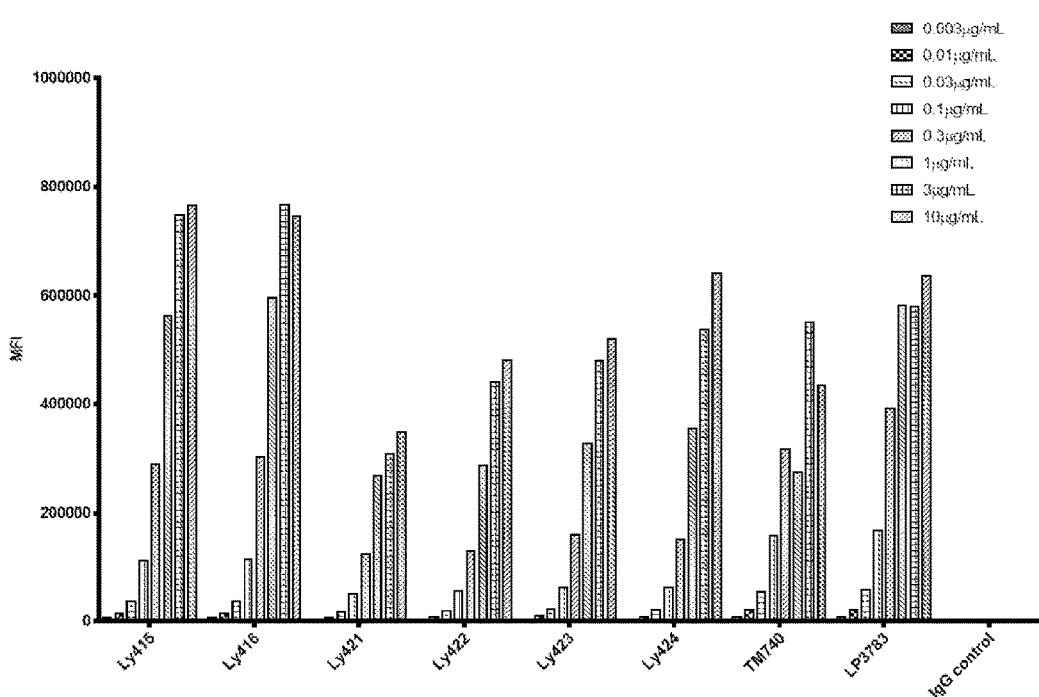
in solution
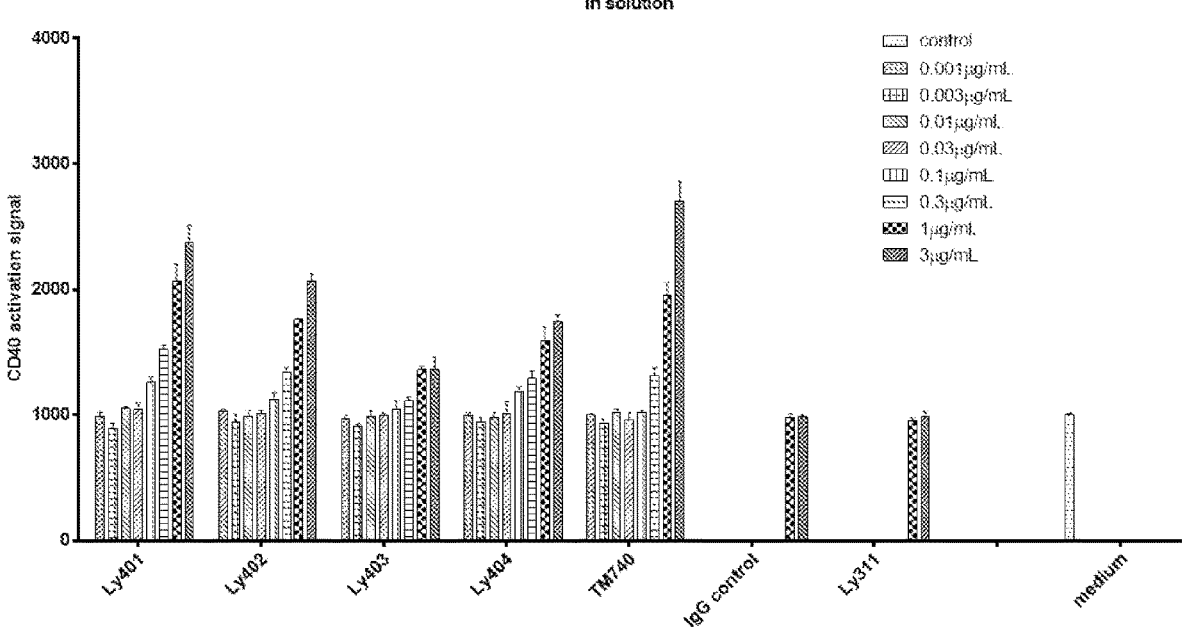
FIG. 28A

FIG.31A
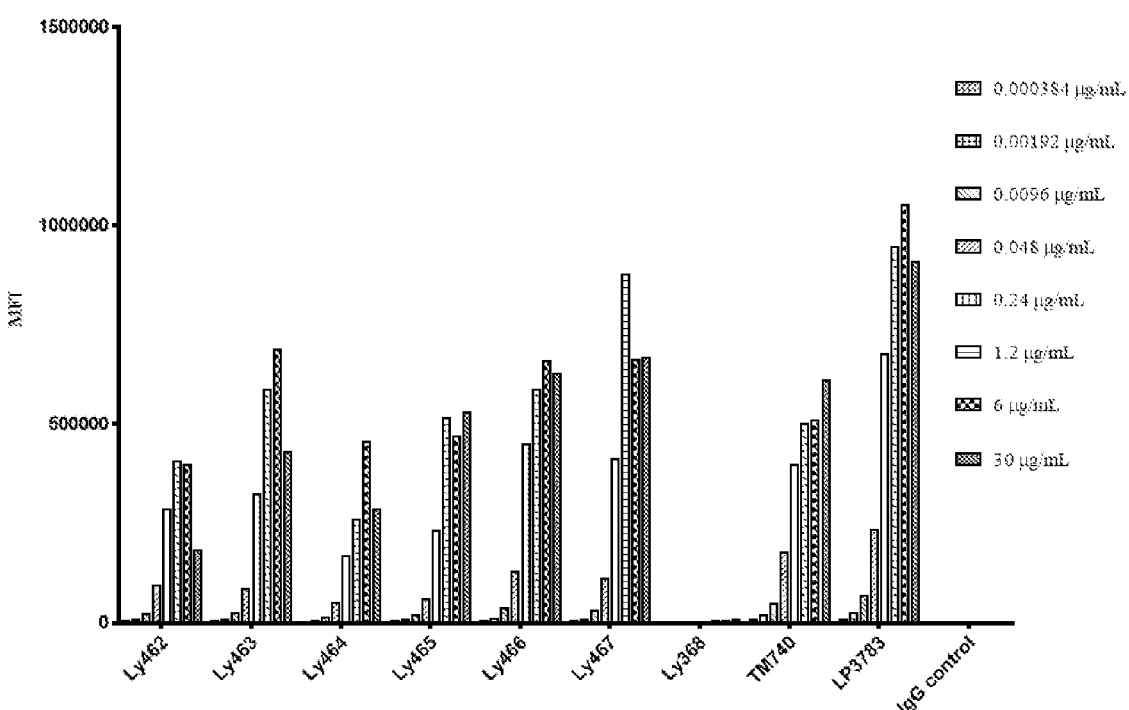
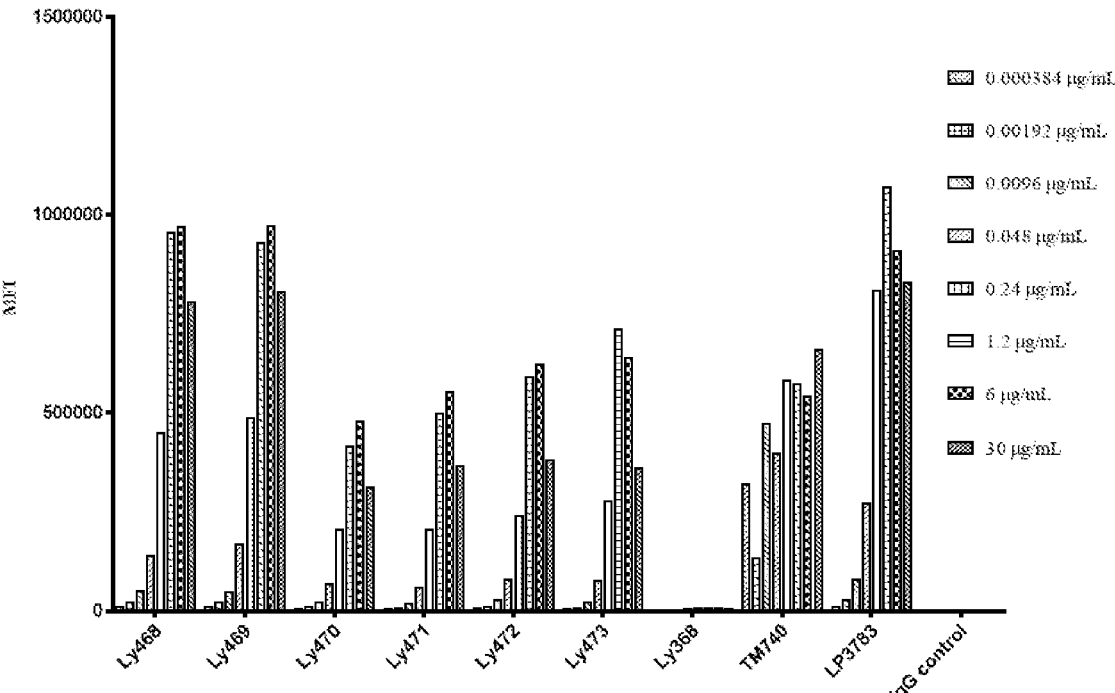
FIG. 31B

FIG. 36 (Cont'd)

Donor 2

ANTI-CD40 BINDING MOLECULES AND BI-SPECIFIC ANTIBODIES COMPRISING SUCH

RELATED APPLICATIONS

The present application is a United States National Phase under 35 U.S.C. § 371 of International Application No. PCT/US2020/057019, filed on Oct. 23, 2020, which claims priority to and the benefit of International Application No. PCT/CN2019/112809, titled "Anti-CD40 Binding Molecules and Bi-Specific Antibodies Comprising Such" and filed on Oct. 23, 2019, the entire contents of both of which are incorporated by reference for all purposes.

SEQUENCE LISTING

The application contains a Sequence Listing that has been filed electronically in the form of a text file, created Apr. 4, 2022, and named "112238-0054-70008WO01_SEQ.TXT" (928,220 bytes), the contents of which are incorporated by reference herein in their entirety.

BACKGROUND OF THE INVENTION

Cluster of differentiation 40 (CD40) is an antigen-presenting cell (APC) costimulatory protein required for APC activation. CD40 is a member of the tumor necrosis factor (TNF)-receptor superfamily and is essential for various immune and inflammatory responses, including T cell-dependent immunoglobulin class switching, memory B cell development, and germinal center formation. Additionally, CD40 is found on the surface of tumor cells, such as B-lymphomas and about 70% of all solid tumors. Its activation has been shown to reverse tolerance to tumor-specific antigens, leading to antigen-specific antitumor immunity.

Therapies involving activated immune cells are promising approaches for eliminating diseased cells such as cancer cells. However, such therapeutic approaches often raise safety concerns. For example, overly activated immune cells would lead to undesired cytotoxicity, causing tissue damage. It is therefore of great interest to develop new immune therapies that are effective and safe.

SUMMARY OF THE INVENTION

The present disclosure is based, at least in part, on the development of humanized anti-CD40 antibodies with similar CD40 binding affinity relative to the murine parent, CD40 agonistic activity, and significant anti-tumor activity. Also provided herein are bi-specific antibodies (bsAb) comprising such and a second antigen-binding moiety specific to a tumor antigen or an immune checkpoint molecule, for example, HER2, necrotic tumor cells (TNT), carcinoembryonic antigen (CEA), PD-1, PD-L1, B7H3, or B7H4. Such bi-specific antibodies showed unexpected superior bioactivities, for example, agonistic activity for CD40, dendritic cell (DC) activation, and in vivo anti-tumor activities, when compared parental monoclonal antibodies from which the bsAbs were obtained. For example, the PD-1/CD40 bsAb clone Ly517 and Ly518, and PD-L1/CD40 bsAb clones Ly338, Ly303, Ly340, Ly342, and Ly343 exhibited superior anti-tumor activities without apparent liver toxicity.

Accordingly, in one aspect, the present disclosure features A humanized antibody specific to human CD40 comprising a heavy chain variable region (V$_H$) and a light chain variable region (V$_L$).

In some embodiment, the humanized anti-CD40 antibody comr\prises a V$_H$ chain that comprises a framework of IGHV3-73*01 and heavy chain complementary determining regions (CDRs) 1, 2, and 3. In some examples, the heavy chain CDRs are identical to those of parent murine antibody Lyv377. In other examples, the heavy chain CDRs collectively contain no more than 5 amino acid residue variations relative to the parent murine antibody Lyv377.

In some embodiments, the humanized anti-CD40 antibody comprises a V$_H$ chain that comprises a framework of IGHV3-23*04 and heavy chain CDRs 1, 2, and 3. In some examples, the heavy chain CDRs are identical to those of parent murine antibody Lyv378. In other examples, the heavy chain CDRs collectively contain no more than 5 amino acid residue variations relative to the parent murine antibody Lyv378.

Alternatively or in addition, the V$_L$ chain of the humanized anti-CD40 antibody discloses herein may comprise a framework of IGKV1-39*01 and light chain CDRs 1, 2, and 3. In some examples, the light chain CDRs are identical to those of the parent murine antibody Lyv377. Alternatively, the light chain CDRs no more than 5 amino acid residue variations relative to the parent murine antibody Lyv377. In some examples, the light chain CDRs are identical to those of the parent murine antibody Lyv378. Alternatively, the light chain CDRs no more than 5 amino acid residue variations relative to the parent murine antibody Lyv378.

In some examples, the humanized anti-CD40 antibody disclosed herein may comprise (a) a heavy chain framework of IGHV3-73*01 and heavy chain CDRs derived from murine patent antibody Lyv377 (e.g., identical or contain no more than 5 amino acid variations collectively), and (b) a light chain framework of IGKV1-39*01 and light chain CDRs derived from murine patent antibody Lyv377 (e.g., identical or contain no more than 5 amino acid variations collectively).

In some examples, the humanized anti-CD40 antibody disclosed herein may comprise (a) a heavy chain framework of IGHV3-23*04 and heavy chain CDRs derived from murine patent antibody Lyv378 (e.g., identical or contain no more than 5 amino acid variations collectively), and (b) a light chain framework of IGKV1-39*01 and light chain CDRs derived from murine patent antibody Lyv378 (e.g., identical or contain no more than 5 amino acid variations collectively).

In specific examples, the humanized anti-CD40 antibody disclosed herein may comprise a V$_H$ chain that comprises a heavy chain CDR1 comprising the amino acid sequence of GFNFNDSFMN (SEQ ID NO:1), GFNFQDSFMN (SEQ ID NO:2), GFNFNDAFMN (SEQ ID NO:3), or GFNFN-DYFMN (SEQ ID NO:4), a heavy chain CDR2 comprising the amino acid sequence of QIRNKNYNYATYYTESLEG (SEQ ID NO:5), and/or a heavy chain CDR3 comprising the amino acid sequence of YYYDGFADYFDY (SEQ ID NO:6). Alternatively or in addition, the humanized anti-CD40 antibody may comprise a V$_L$ chain that comprises the light chain CDR1, light chain CDR2, and/or light chain CDRs, which comprise the amino acid sequences KASQNIYIYLN (SEQ ID NO:7), NTNNLQT (SEQ ID NO:8), and LQHSSRRT (SEQ ID NO:9), respectively.

In some embodiments, the V$_H$ in the humanized anti-CD antibody may comprise one or more mutations in the V$_H$ framework relative to the wild-type counterpart. In some examples, the mutations in the V$_H$ framework are back mutations based on amino acid residues in the parent murine antibody at the corresponding positions. Exemplary back mutations include E1Q, A24T, F70V, and/or R100S. In some specific examples, the $V_H$ of the humanized anti-CD40 antibody may comprise the amino acid sequence of SEQ ID NOs: 10-14. Alternatively or in addition, the $V_L$ of the humanized anti-CD40 antibody may comprise the amino acid sequence of SEQ ID NO:15.

In some embodiments, the heavy chain CDR1, the heavy chain CDR2, and the heavy chain CDR3 in a humanized anti-CD40 antibody disclosed herein may comprise the amino acid sequences of GFTFTNYGLH (SEQ ID NO:16), SISPSGGVTYYRDSVKG (SEQ ID NO: 17), and PFLGWGGANWIAH (SEQ ID NO:18), respectively. Alternatively or in addition, the light chain CDR1, the light chain CDR2, and the light chain CDR3 of the humanized anti-CD40 antibody may comprise the amino acid sequences of LASEDISNDLA (SEQ ID NO:19), FVDRLLD (SEQ ID NO:20), and QQSYKYPPT (SEQ ID NO:21), respectively. In specific examples, the $V_H$ may comprise the amino acid sequence of SEQ ID NO: 22 and/or the $V_L$ may comprise the amino acid sequence of SEQ ID NO:23.

Any of the humanized anti-CD40 antibodies disclosed herein may be a full-length antibody. In some examples, the full-length antibody an be an IgG/kappa molecule. For example, the full-length antibody may comprise a heavy chain that is an IgG1, IgG2, or IgG4 chain. In some examples, the heavy chain may comprise a mutated Fc region, which exhibits altered binding affinity or selectivity to an Fc receptor as compared with the wild-type counterpart.

In specific examples, the humanized anti-CD40 antibodies may be TM550, TM553, LP3771, LP3772, LP3773, TM738, TM739, TM740, and Ly181. Alternatively, the humanized anti-CD40 antibodies may be TM559, LP3781, LP3782, and LP3783.

In another aspect, provided herein are anti-PD-L1 antibody, comprising (i) a heavy chain variable region ($V_H$) comprising heavy chain complementary determining regions (CDRs) 1, 2, and 3, which are either identical to those of reference antibody Lyv5574 or contain no more than 5 amino acid residue variations relative to the reference antibody Lyv5574; and (ii) a light chain variable region ($V_L$) comprising light chain CDRs 1, 2, and 3, which are either identical to those of reference antibody Lyv5574 or contain no more than 5 amino acid residue variations relative to the reference antibody Lyv5574. In some examples, the anti-PD-L1 antibody comprises a $V_H$ that comprises heavy chain CDRs that are identical to those of antibody Lyv5574 and a $V_L$ that comprises light chain CDRs that are identical to those of reference antibody Lyv5574.

In some embodiments, the heavy chain CDR1, the heavy chain CDR2, and the heavy chain CDR3 of the anti-PD-L1 antibody disclosed herein may comprise the amino acid sequences of GYTFTDFWMS (SEQ ID NO:24), QIYPNTGTTHSNEKFKG (SEQ ID NO: 25), and SYHISTTPNWFAY (SEQ ID NO:26), respectively. Alternatively or in addition, the light chain CDR1, the light chain CDR2, and the light chain CDR3 of the anti-PD-L1 antibody may comprise the amino acid sequences of KASQN-VYKKLE (SEQ ID NO:27), HTNILQT (SEQ ID NO:28), and YQWNSGPT (SEQ ID NO:29), respectively.

Any of the anti-PD-L1 antibodies disclosed herein may be a human or humanized antibody. In some examples, the $V_H$ of a humanized antibody may comprise a human IGHV1-46*01 framework. Alternatively or in addition, the $V_L$ of the humanized antibody may comprise a human IGKV1-27*01 framework. In specific examples, the $V_H$ may comprise the amino acid sequence of SEQ ID NO:30, and/or the $V_L$ comprises the amino acid sequence of SEQ ID NO:31.

In some embodiments, the $V_H$ and/or the $V_L$ of a humanized anti-PD-L1 antibody as disclosed herein may comprise one or more mutations in the human $V_H$ and/or $V_L$ framework as compared with the wild-type counterpart, for example, at position L42 (e.g., L42V) and/or F71 (e.g., F71V) in the $V_L$ chain. In one example, the $V_L$ of the humanized anti-PD-L1 antibody may comprise the amino acid sequence of SEQ ID NO:32.

Any of the anti-PD-L1 antibodies disclosed herein may be a full-length antibody, for example, an IgG1/kappa molecule. In some instances, the full-length antibody may comprise a heavy chain, which comprises a mutated Fc region having altered binding affinity or specificity to an Fc receptor as compared with its wild-type counterpart.

In specific examples, the anti-PD-L1 antibody disclosed herein is Ly074, Ly075, or Ly076.

In yet another aspect, the present disclosure provides an isolated anti-B7H3 antibody, comprising: (i) a heavy chain variable region ($V_H$) that comprises heavy chain complementary determining regions (CDRs) 1, 2, and 3, which are either identical to those of reference antibody Lyv383 or Lyv387, or contain no more than 5 amino acid residue variations relative to the reference antibody Lyv383 or Lyv387; and (ii) a light chain variable region ($V_L$) that comprises light chain CDRs 1, 2, and 3, which are either identical to those of reference antibody Lyv383 or Lyv387, or contain no more than 5 amino acid residue variations relative to the reference antibody Lyv383 or Lyv387.

In some examples, the anti-B7H3 antibody may comprise a $V_H$ that comprises heavy chain CDRs derived from reference antibody Lyv383 (e.g., identical or contain no more than 5 amino acid variations) and a $V_L$ that comprises light chain CDRs derived from reference antibody Lyv383 (e.g., identical or contain no more than 5 amino acid variations). For example, the anti-B7H3 antibody may comprise a $V_H$ that comprises the same heavy chain CDRs as reference antibody Lyv383 and a $V_L$ that comprises the same light chain CDRs as reference antibody Lyv383.

In some examples, the anti-B7H3 antibody may comprise a $V_H$ that comprises heavy chain CDRs derived from reference antibody Lyv387 (e.g., identical or contain no more than 5 amino acid variations) and a $V_L$ that comprises light chain CDRs derived from reference antibody Lyv387 (e.g., identical or contain no more than 5 amino acid variations). For example, the anti-B7H3 antibody may comprise a $V_H$ that comprises the same heavy chain CDRs as reference antibody Lyv387 and a $V_L$ that comprises the same light chain CDRs as reference antibody Lyv387.

In some embodiments, the anti-B7H3 antibody disclosed herein may comprise (a) the heavy chain CDR1, the heavy chain CDR2, and the heavy chain CDR3 comprise the amino acid sequences of GYTFTSYVMH (SEQ ID NO:33), INPYNDGTECTDKFKG (SEQ ID NO: 34), and SIYYGYDGTYFGV (SEQ ID NO:35), respectively, or (b) the heavy chain CDR1, the heavy chain CDR2, and the heavy chain CDR3 comprise the amino acid sequences of GYTFTSYWMH (SEQ ID NO:36), MIHPNSGGTNYNEKFKG (SEQ ID NO: 37), and SQATWFAY (SEQ ID NO:38), respectively. Alternatively or in addition, the anti-B7H3 antibody disclosed herein may comprise (a) the light chain CDR1, the light chain CDR2, and the light chain CDR3 comprises the amino acid sequences of RASSSVSYMH (SEQ ID NO:39), TSNLAS (SEQ ID NO:40), and QQWSSNTLT (SEQ ID NO:41), respectively; or (b) the light chain CDR1, the light chain CDR2, and the light chain CDR3 comprises the amino acid sequences of RASSSVSSSYLH (SEQ ID NO:42), STSN-LAS (SEQ ID NO:43), and QHYSGYPLT (SEQ ID NO:44), respectively.

In some examples, the anti-B7H3 antibody disclosed herein may comprise (a) the heavy chain CDR1, the heavy chain CDR2, and the heavy chain CDR3, which comprise the amino acid sequences of GYTFTSYVMH (SEQ ID NO:33), INPYNDGTECTDKFKG (SEQ ID NO: 34), and SIYYGYDGTYFGV (SEQ ID NO:35), respectively, and (b) the light chain CDR1, the light chain CDR2, and the light chain CDR3, which comprises the amino acid sequences of RASSSVSYMH (SEQ ID NO:39), TSNLAS (SEQ ID NO:40), and QQWSSNTLT (SEQ ID NO:41), respectively. In specific examples, the $V_H$ in the anti-B7H3 antibody may comprise the amino acid sequence of SEQ ID NO:45, and/or wherein the $V_L$ may comprise the amino acid sequence of SEQ ID NO:46.

In other examples, the anti-B7H3 antibody disclosed herein may comprise (a) the heavy chain CDR1, the heavy chain CDR2, and the heavy chain CDR3, which comprise the amino acid sequences of GYTFTSYWMH (SEQ ID NO:36), MIHPNSGGTNYNEKFKG (SEQ ID NO:37), and SQATWFAY (SEQ ID NO:38), respectively; and (b) the light chain CDR1, the light chain CDR2, and the light chain CDR3, which comprises the amino acid sequences of RASSSVSSSYLH (SEQ ID NO:42), STSNLAS (SEQ ID NO:43), and QHYSGYPLT (SEQ ID NO:44), respectively. In specific examples, the $V_H$ of the anti-B7H3 antibody may comprise the amino acid sequence of SEQ ID NO:47, and/or the $V_L$ may comprise the amino acid sequence of SEQ ID NO:48.

Any of the anti-B7H3 antibodies disclosed herein may be a human or humanized antibody. In some embodiments, the antibody is a full-length antibody, for example, an IgG/kappa molecule. In some embodiments, the full-length antibody comprises a heavy chain, which comprises a mutated Fc region having altered binding affinity or specificity to an Fc receptor relative to the wild-type counterpart.

In addition, the present disclosure also features an isolated anti-B7H4 antibody, comprising: (i) a heavy chain variable region ($V_H$) that comprises heavy chain complementary determining regions (CDRs) 1, 2, and 3, which are either identical to those of reference antibody Lyv361 or Lyv366, or contain no more than 5 amino acid residue variations relative to the reference antibody Lyv361 or Lyv366; and (ii) a light chain variable region ($V_H$) that comprises light chain CDRs 1, 2, and 3, which are either identical to those of reference antibody Lyv361 or Lyv366, or contain no more than 5 amino acid residue variations relative to the reference antibody Lyv361 or Lyv366.

In some examples, the anti-B7H4 antibody may comprise a $V_H$ that comprises heavy chain CDRs derived from reference antibody Lyv361 (e.g., identical or contain no more than 5 amino acid variations) and a $V_L$ that comprises light chain CDRs derived from reference antibody Lyv361 (e.g., identical or contain no more than 5 amino acid variations). For example, the anti-B7H4 antibody may comprise a $V_H$ that comprises the same heavy chain CDRs as reference antibody Lyv361 and a $V_L$ that comprises the same light chain CDRs as reference antibody Lyv361.

In some examples, the anti-B7H4 antibody may comprise a $V_H$ that comprises heavy chain CDRs derived from reference antibody Lyv366 (e.g., identical or contain no more than 5 amino acid variations) and a $V_L$ that comprises light chain CDRs derived from reference antibody Lyv366 (e.g., identical or contain no more than 5 amino acid variations). For example, the anti-B7H3 antibody may comprise a $V_H$ that comprises the same heavy chain CDRs as reference antibody Lyv366 and a $V_L$ that comprises the same light chain CDRs as reference antibody Lyv366.

In some embodiments, the anti-B7H4 antibody disclosed herein may comprise: (a) the heavy chain CDR1, the heavy chain CDR2, and the heavy chain CDR3 that comprise the amino acid sequences of GFTFSSYGMS (SEQ ID NO:49), AISTGGSYTYYPDSVKG (SEQ ID NO: 50), and RGATGSWFAY (SEQ ID NO:51), respectively, or (b) the heavy chain CDR1, the heavy chain CDR2, and the heavy chain CDR3 that comprise the amino acid sequences of GFTFSDSGMH (SEQ ID NO:52), YINSGSSTIYY-ADSVKG (SEQ ID NO:53), and GRGYAMDY (SEQ ID NO:54), respectively. Alternatively or in addition, the anti-B7H4 antibody may comprise: (a) the light chain CDR1, the light chain CDR2, and the light chain CDR3 that comprise the amino acid sequences of HASQGINNNIG (SEQ ID NO:55), GTNLED (SEQ ID NO:56), and VQYVQFPRT (SEQ ID NO:57), respectively; or (b) the light chain CDR1, the light chain CDR2, and the light chain CDR3 that comprise the amino acid sequences of SASSSISSDFLH (SEQ ID NO:58), RISNLAS (SEQ ID NO:59), and QQG-SNVPRT (SEQ ID NO:60), respectively.

In some examples, the anti-B7H4 antibody disclosed herein may comprise (a) the heavy chain CDR1, the heavy chain CDR2, and the heavy chain CDR3 that comprise the amino acid sequences of GFTFSSYGMS (SEQ ID NO:49), AISTGGSYTYYPDSVKG (SEQ ID NO: 50), and RGATGSWFAY (SEQ ID NO:51), respectively, and (b) the light chain CDR1, the light chain CDR2, and the light chain CDR3 that comprise the amino acid sequences of HASQGINNNIG (SEQ ID NO:55), GTNLED (SEQ ID NO:56), and VQYVQFPRT (SEQ ID NO:57), respectively. In specific examples, the anti-B7H4 antibody disclosed herein may comprise a $V_H$ of SEQ ID NO:61, and/or a $V_L$ of SEQ ID NO:62.

In other examples, the anti-B7H4 antibody disclosed herein may comprise: (a) the heavy chain CDR1, the heavy chain CDR2, and the heavy chain CDR3 that comprise the amino acid sequences of GFTFSDSGMH (SEQ ID NO:52), YINSGSSTIYYADSVKG (SEQ ID NO: 53), and GRG-YAMDY (SEQ ID NO:54), respectively; and (b) the light chain CDR1, the light chain CDR2, and the light chain CDR3 that comprise the amino acid sequences of SASS-SISSDFLH (SEQ ID NO:58), RISNLAS (SEQ ID NO:59), and QQGSNVPRT (SEQ ID NO: 60), respectively. In specific examples, the anti-B7H4 antibody may comprise a $V_H$ of SEQ ID NO:63, and/or wherein a $V_L$ of SEQ ID NO:64.

Any of the anti-B7H4 antibodies disclosed herein may be a human, humanized antibody, or chimeric antibody. Alternatively or in addition, the antibody may be a full-length antibody, for example, an IgG/kappa molecule. In some examples, the full-length antibody may comprise a heavy chain, which comprises a mutated Fc region having altered binding affinity or specificity to an Fc receptor as compared with the wild-type counterpart.

In some aspects, provided herein is an isolated anti-PD-1 antibody, wherein the antibody comprises: (i) a heavy chain variable region ($V_H$) comprising heavy chain complementary determining regions (CDRs) 1, 2, and 3, which are identical to those of reference antibody Ly516; and (ii) a light chain variable region ($V_L$) comprising light chain CDRs 1, 2, and 3, which are identical to those of reference antibody Ly516. In some embodiments, the anti-PD-1 antibody may comprise the same $V_H$ and same $V_L$ as antibody Ly516. Any of the anti-PD-1 antibodies disclosed herein may be a full-length antibody. In some examples, the full-length antibody is an IgG/kappa molecule. In specific examples, the full-length antibody comprises a heavy chain, which comprises a mutated Fc region having altered binding affinity or specificity to an Fc receptor as relative to its wild-type counterpart. Further, provided herein is a bispecific antibody, comprising: (a) a first antibody moiety that binds human CD40, and (b) a second antibody moiety that binds an antigen selected from the group consisting of HER2, necrotic tumor cells (TNT), carcinoembryonic antigen (CEA), PD-1, PD-L1, B7H3, and B7H4. In some embodiments, either the first antibody moiety or the second antibody moieity is in a single-chain antibody (scFv) format. The scFv moiety may be in the $V_H$ to $V_L$ orientation (from N-terminus to C-terminus). In other examples, the scFv moiety may be in the $V_L$ to $V_H$ orientation (from N-terminus to C-terminus). Alternatively or in addition, the other antibody moiety is in a full-length antibody format comprising a heavy chain and a light chain.

In some embodiments, the first antibody moiety that binds human CD40 is a scFv and/or the second antibody moiety comprises a first polypeptide comprising an antibody heavy chain and a second polypeptide comprising an antibody light chain. The scFv may be fused to either the first polypeptide or the second polypeptide. In some examples, the anti-CD40 scFv chain is fused to the first polypeptide, which comprises a heavy chain of an antibody specific to the second antigen, e.g., those disclosed herein. The scFv may be fused to the N-terminus of the first polypeptide. Alternatively, the scFv may be fused to the C-terminus of the first polypeptide. In other examples, the anti-CD40 scFv chain is fused to the second polypeptide, which comprises a light chain of an antibody specific to the second antigen, e.g., those disclosed herein. The scFv may be fused to the N-terminus of the second polypeptide. Alternatively, the scFv may be fused to the C-terminus of the second polypeptide.

In some embodiments, the first antibody moiety that binds human CD40 is a humanized anti-CD40 antibody as disclosed herein, e.g., those derived from Lyv377 or Lyv378. In some examples, the humanized anti-CD40 antibody (e.g., in scFv format) may comprise a $V_H$ chain comprising the amino acid sequence of SEQ ID NOs: 10-14 and/or a $V_L$ chain comprising the amino acid sequence of SEQ ID NO:15. In some examples, the humanized anti-CD40 antibody (e.g., in scFv format) may comprise a $V_H$ chain comprising the amino acid sequence of SEQ ID NO:22 and/or a $V_L$ chain comprising the amino acid sequence of SEQ ID NO:23. In other embodiments, the first antibody moiety that binds human CD40 can have the same heavy chain and light chain CDRs as antibody Ly253.

In some embodiments, the second antibody moiety binds PD-L1, for example, any of the anti-PD-L1 antibodies disclosed herein. In some examples, the anti-PD-L1 moiety may comprise a $V_H$ comprising the amino acid sequence of SEQ ID NO:30 and/or a $V_L$ comprising the amino acid sequence of SEQ ID NO:31. In some examples, the anti-PD-L1 moiety may comprise a $V_H$ comprising the amino acid sequence of SEQ ID NO:30 and/or a $V_L$ comprising the amino acid sequence of SEQ ID NO:32. Examples of the anti-CD40/anti-PD-L1 bispecific antibodies include Ly301, Ly303, Ly338, Ly339, Ly340, Ly341, Ly342, Ly343, Ly344, Ly345, Ly349, and Ly350.

In some embodiments, the second antibody moiety binds B7H3, for example, any of the anti-B7H3 antibodies disclosed herein. In some examples, the anti-B7H3 antibody may comprise a $V_H$ comprising the amino acid sequence of SEQ ID NO:45, and/or a $V_L$ comprising the amino acid sequence of SEQ ID NO:46. In some examples, the anti- B7H3 antibody may comprise a $V_H$ comprising the amino acid sequence of SEQ ID NO:47, and/or a $V_L$ comprising the amino acid sequence of SEQ ID NO:48. Examples of the anti-CD40/anti-B7H3 bispecific antibodies include Ly610, Ly611, Ly612, Ly613, Ly614, Ly615, Ly616, Ly617, Ly801, Ly802, Ly803, Ly804, Ly805, Ly806, Ly807, Ly808, Ly809, Ly810, Ly811, Ly812, Ly813, Ly814, Ly815, and Ly816.

In some embodiments, the second antibody moiety binds B7H4, for example, any of the anti-B7H4 antibodies disclosed herein. In some examples, the anti-B7H4 antibody may comprise a $V_H$ comprising the amino acid sequence of SEQ ID NO:61, and/or a $V_L$ comprising the amino acid sequence of SEQ ID NO:62. In some examples, the anti-B7H4 antibody may comprise a $V_H$ comprising the amino acid sequence of SEQ ID NO:63, and/or a $V_L$ comprising the amino acid sequence of SEQ ID NO:64. Examples of anti-CD40/anti-B7H4 bispecific antibodies include Ly474, Ly475, Ly476, Ly477, Ly478, Ly479, Ly480, Ly481, Ly482, Ly483, Ly484, Ly485, Ly486, Ly487, Ly488, Ly489, Ly490, Ly491, Ly492, Ly493, Ly494, Ly495, Ly496, and Ly497.

In some embodiments, the second antibody moiety binds CEA. For example, the second antibody moiety may comprise the same heavy chain CDRs as reference antibody Ly311, and/or the same light chain CDRs as reference antibody Ly311. In some examples, the second antibody moiety may comprise the same $V_H$ as reference antibody Ly311, and/or the same $V_L$ as reference antibody Ly311. In some embodiments, the second antibody moiety comprises the same heavy chain CDRs as reference antibody Ly312, and/or the same light chain CDRs as reference antibody Ly312. In some examples, the second antibody moiety may comprise the same $V_H$ (e.g., heavy chain) as reference antibody Ly312, and/or the same $V_L$ (e.g., the same light chain) as reference antibody Ly312. Examples include Ly401, Ly402, Ly403, Ly404, Ly405, Ly406, Ly407, Ly408, Ly409, Ly410, Ly411, Ly412, Ly413, Ly414, Ly415, Ly416, Ly417, Ly418, Ly419, Ly420, Ly421, Ly422, Ly423, and Ly424.

In some embodiments, the second antibody moiety binds TNT (necrotic tumor cells). In some examples, the second antibody moiety comprises the same heavy chain CDRs as reference antibody Ly368; and/or the same light chain CDRs as the reference antibody Ly368. In some examples, the second antibody moiety comprises the same $V_H$ (e.g., heavy chain) as the reference antibody Ly368; and/or the same $V_L$ (e.g., light chain) as the reference antibody Ly368. Examples include Ly462, Ly463, Ly464, Ly465, Ly466, Ly467, Ly468, Ly469, Ly470, Ly471, Ly472, and Ly473.

In some embodiments, the second antibody moiety binds PD-1. For example, the second antibody moiety comprises the same heavy chain CDRs as antibody Ly516; and/or the same light chain CDRs as antibody Ly516. In some examples, the second antibody moiety comprises the same $V_H$ (e.g., heavy chain) as antibody Ly516; and/or wherein the second antibody moiety comprises the same $V_L$ (e.g., light chain) as antibody Ly516. Examples of anti-CD40/anti-PD1 bispecific antibodies include Ly517, Ly518, Ly519, Ly520, Ly606, Ly607, Ly608, Ly609, Ly817, Ly818, Ly819, and Ly820.

In some embodiments, the second antibody moiety binds HER2. For example, the second antibody moiety comprises the same heavy chain CDRs as reference antibody TM737 and/or the same light chain CDRs as the reference antibody TM737. In some examples, the second antibody moiety comprises the same $V_H$ (e.g., heavy chain) as the reference antibody TM737 and/or the same $V_L$ (e.g., light chain) as the reference antibody TM737. In other examples, the second antibody moiety comprises the same heavy chain CDRs as reference antibody Ly591 and/or the same light chain CDRs as the reference antibody Ly591. In some examples, the second antibody moiety comprises the same V$_H$ (e.g., heavy chain) as the reference antibody Ly591 and/or the same V$_L$ (e.g., light chain) as the reference antibody Ly591. Examples of anti-CD40/anti-HER2 bispecific antibodies include Ly618, Ly619, Ly620, Ly621, Ly622, Ly623, Ly624, Ly625, Ly821, Ly822, Ly823, Ly824, Ly825, Ly826, Ly827, Ly828, Ly829, Ly830, Ly831, Ly832, Ly833, Ly834, Ly835, and Ly836.

Also provided herein is a nucleic acid or a nucleic acid set, which collectively encodes any of the antibodies disclosed herein. In some examples, the nucleic acid or nucleic acid set can be an expression vector or an expression vector set. Further, provided herein is a host cell (e.g., a mammalian host cell) comprising any of the nucleic acids or nucleic acid sets disclosed herein.

Further, the present disclosure features a method for producing any of the antibodies disclosed herein, the method comprising: (i) culturing any of the host cells disclosed herein under conditions allowing for expression of the antibody; and (ii) harvesting the antibody thus produced.

Also with the scope of the present disclosure is a method for modulating immune responses, comprising administering an effective amount of any of the antibodies disclosed here to a subject in need thereof. In some examples, the subject is a human patient having or suspected of having cancer. Further, provided herein are pharmaceutical compositions comprising any of the antibodies disclosed herein for use in treating the target diseases disclosed herein or uses of such antibodies for manufacturing medicaments for the intended medical uses as also disclosed herein.

The details of one or more embodiments of the invention are set forth in the description below. Other features or advantages of the present invention will be apparent from the following drawings and detailed description of several embodiments, and also from the appended claims.

BRIEF DESCRIPTION OF THE DRAWINGS

The following drawings form part of the present specification and are included to further demonstrate certain aspects of the present disclosure, which can be better understood by reference to the drawing in combination with the detailed description of specific embodiments presented herein.

FIGS. 15A-15D include a set of bar graphs showing the activity of exemplary anti-PD-L1/CD40 bispecific antibodies in activation of human dendritic cells (DC) from two healthy donors by the antibodies either in solution (FIGS. 15A and 15C) or in co-culture of CHO cells expressing human PD-L1 (FIGS. 15B and 15D). DC activation is indicated by the bar graphs signal of IL-8 in the culture supernatant. The De activation activity of the bispecific antibodies are much higher than the anti-CD40 mAbs.

G2 and Ly076. 17C: anti-tumor effects of clones Ly342, Ly343, Ly253-G2 and Ly076.

Figures 18, 19A:
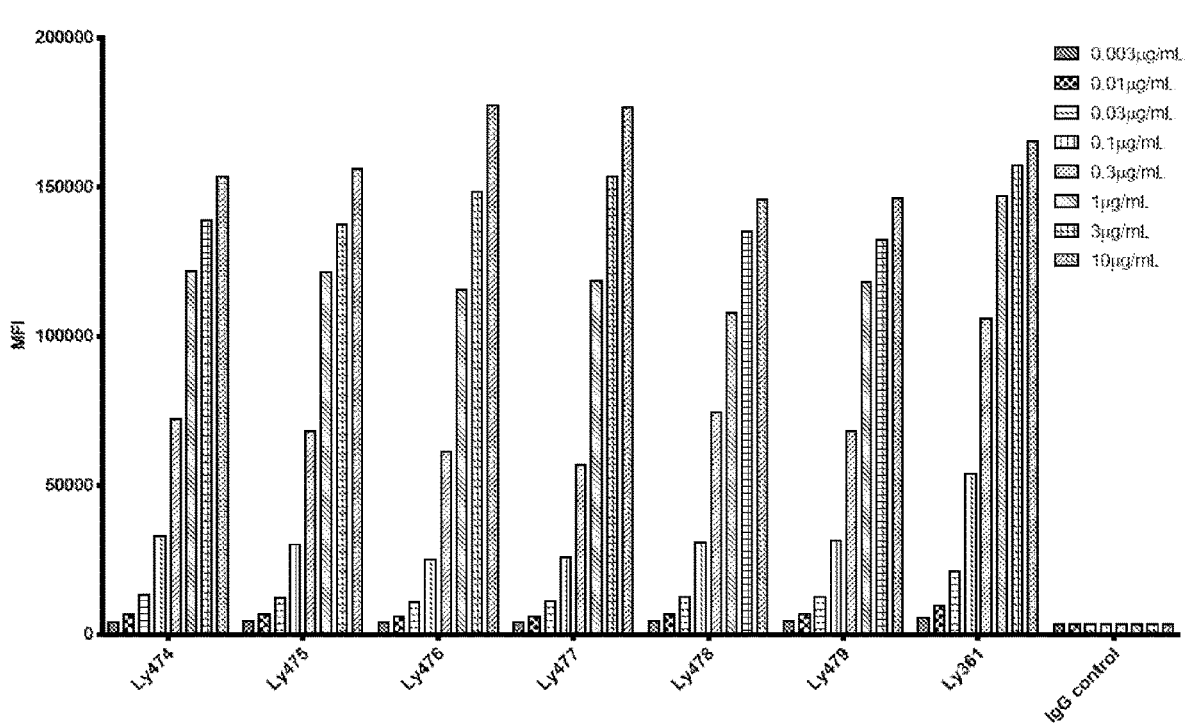
Figure 19B:
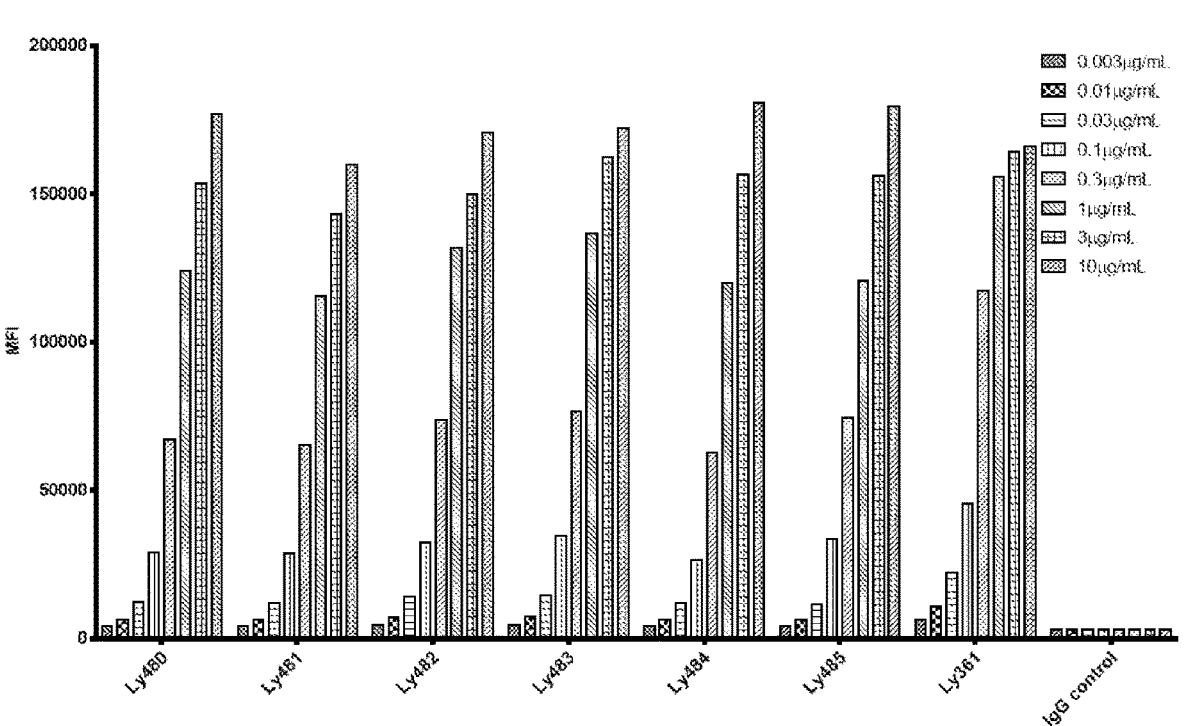
Figure 19C:
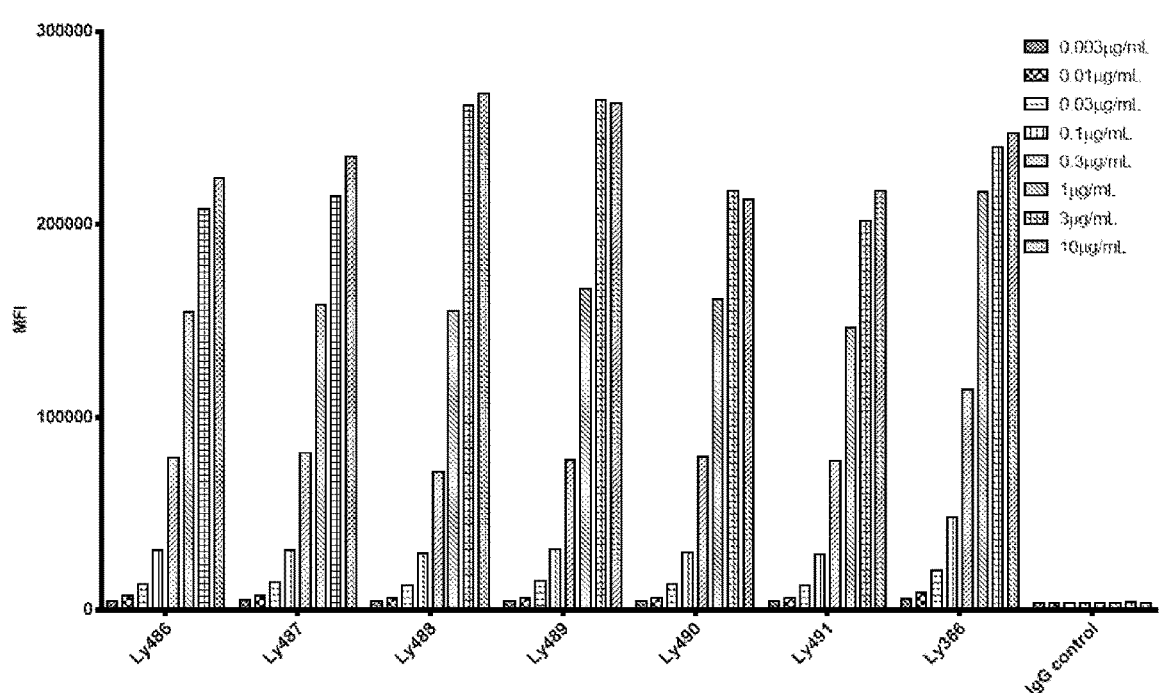
Figure 19D:
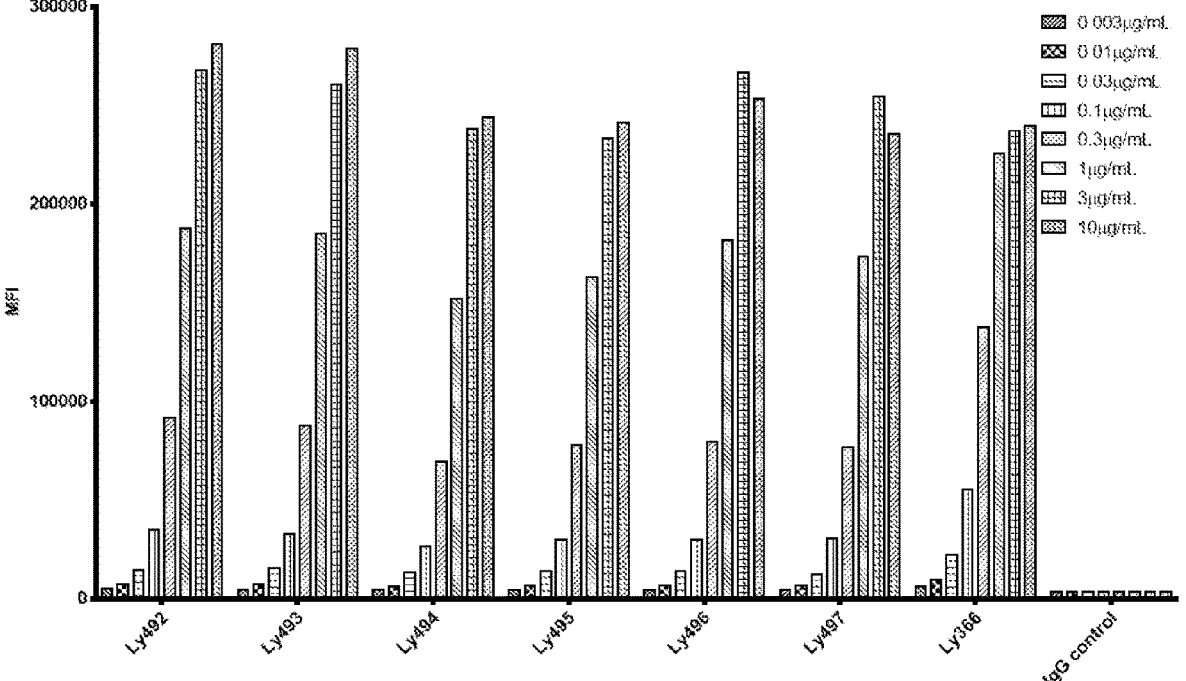
Figure 20A:
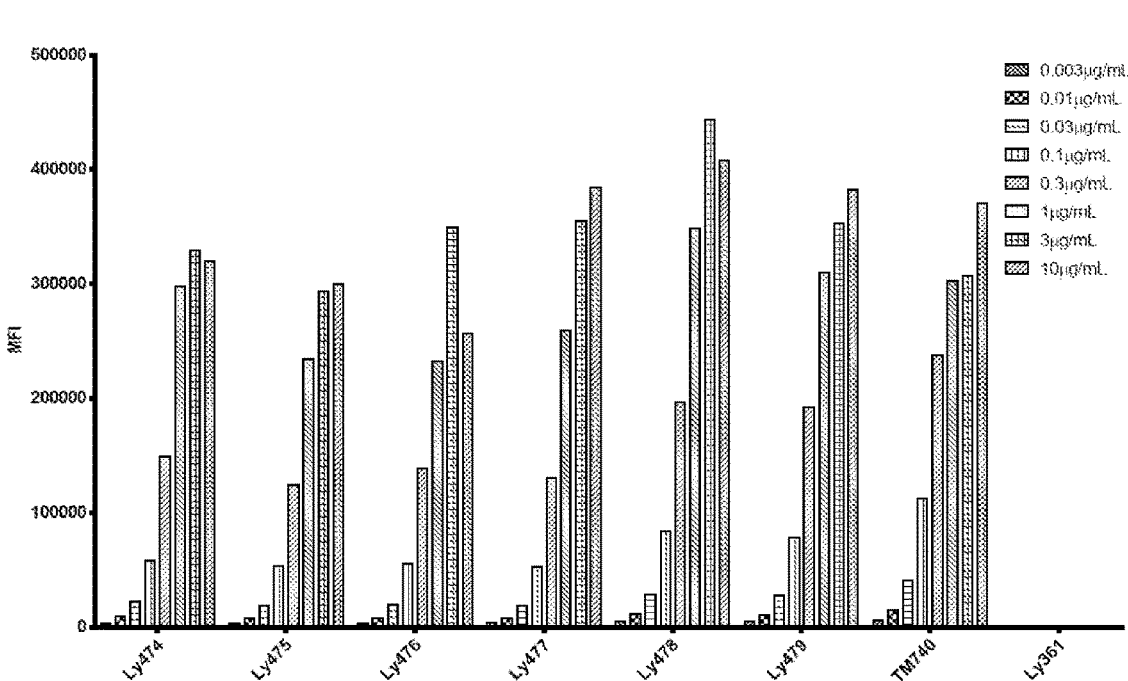
Figure 20B:
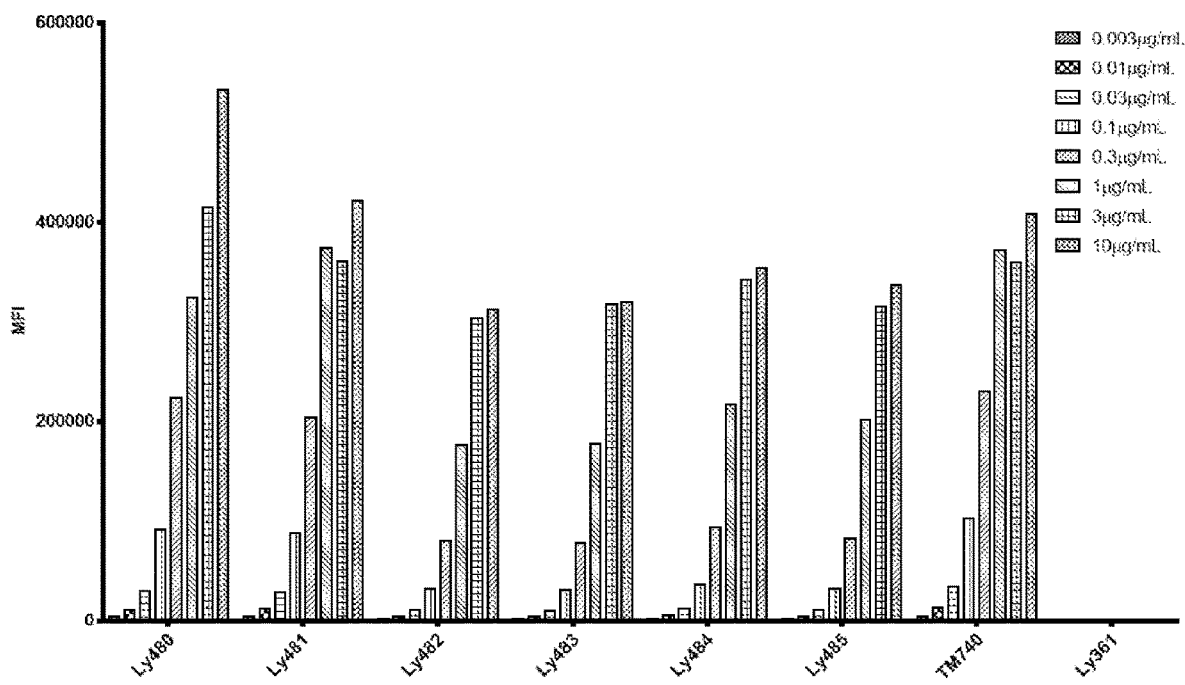
Figure 20C:
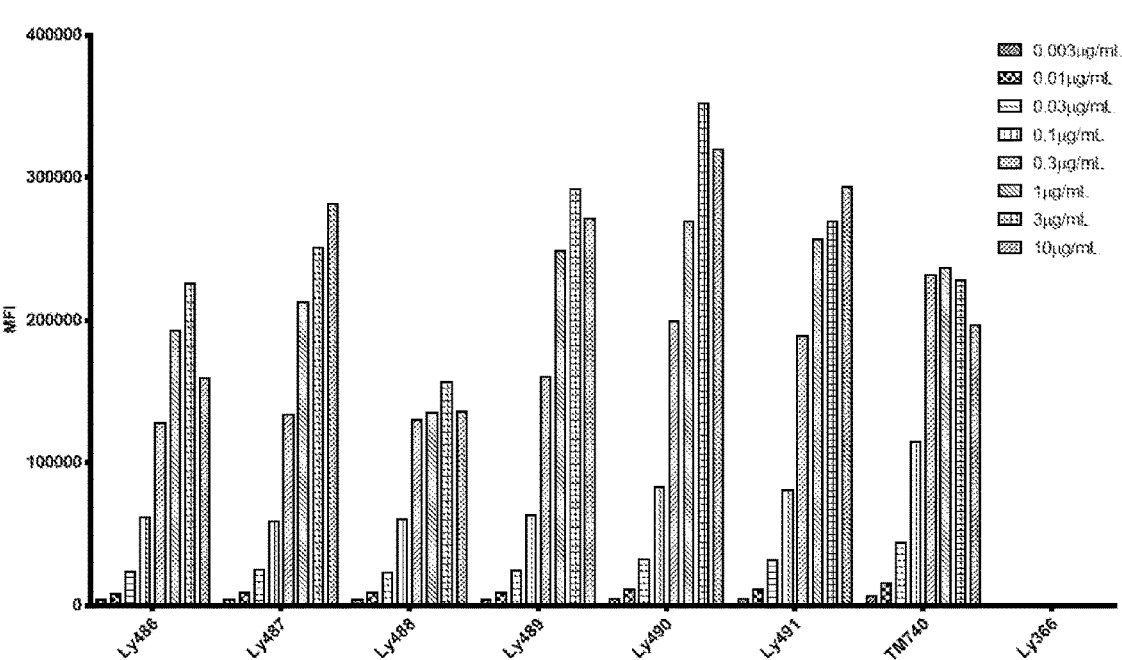
Figure 20D:
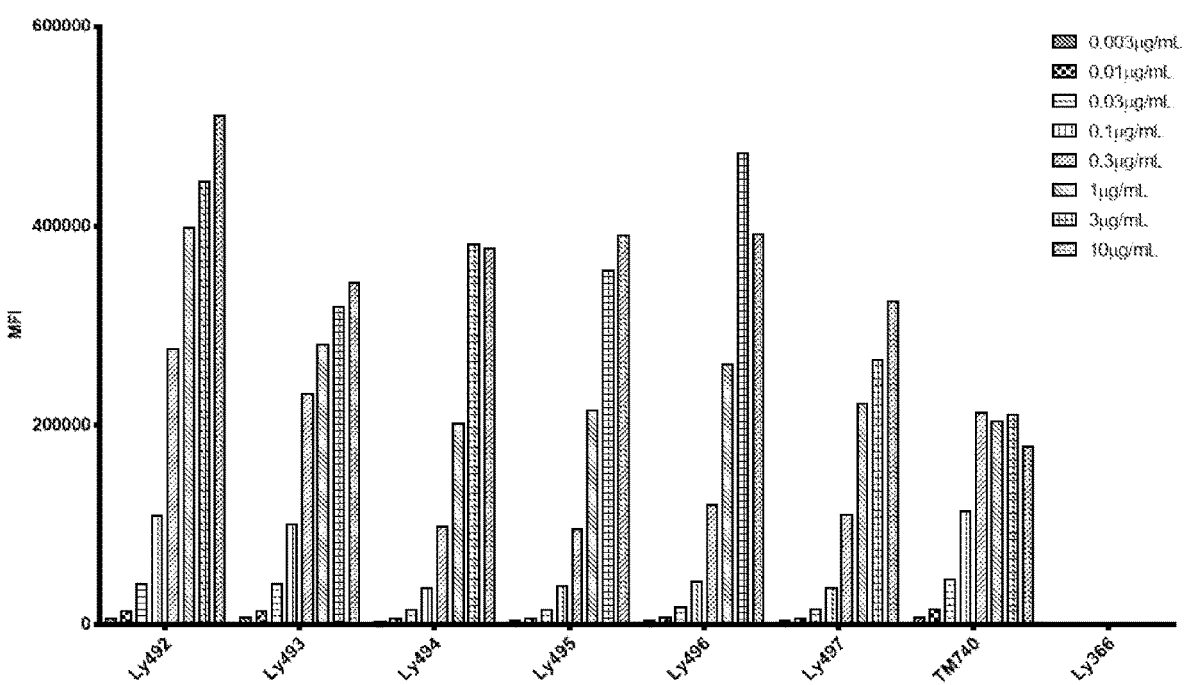
Figure 21A:
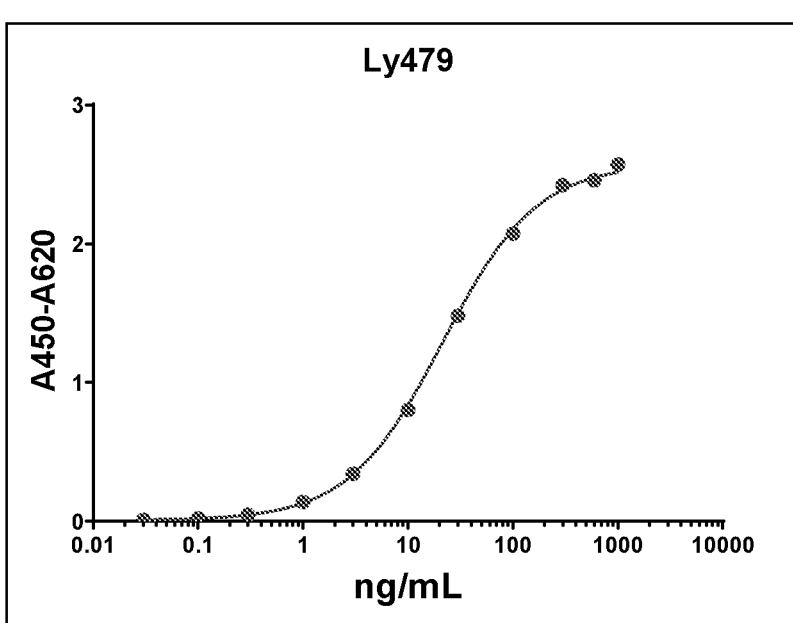
Figure 21B:
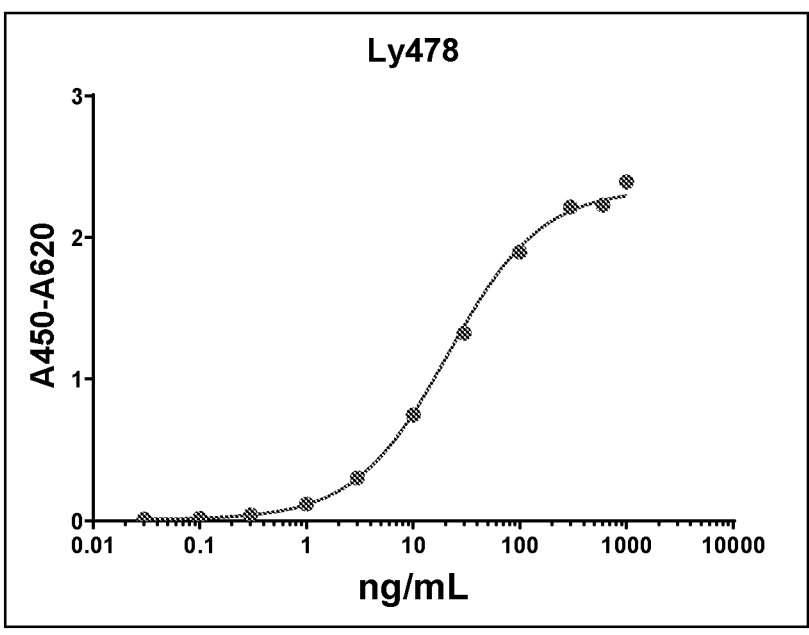
Figure 21C:
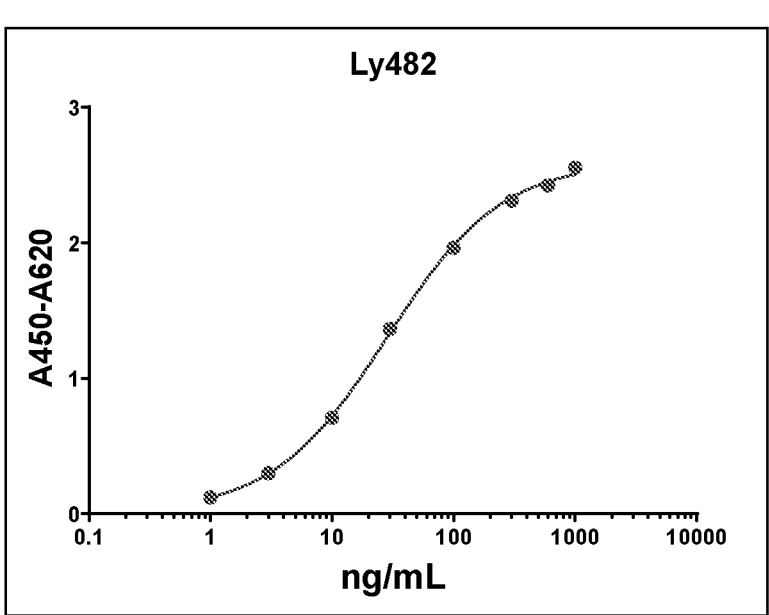
Figure 21D:
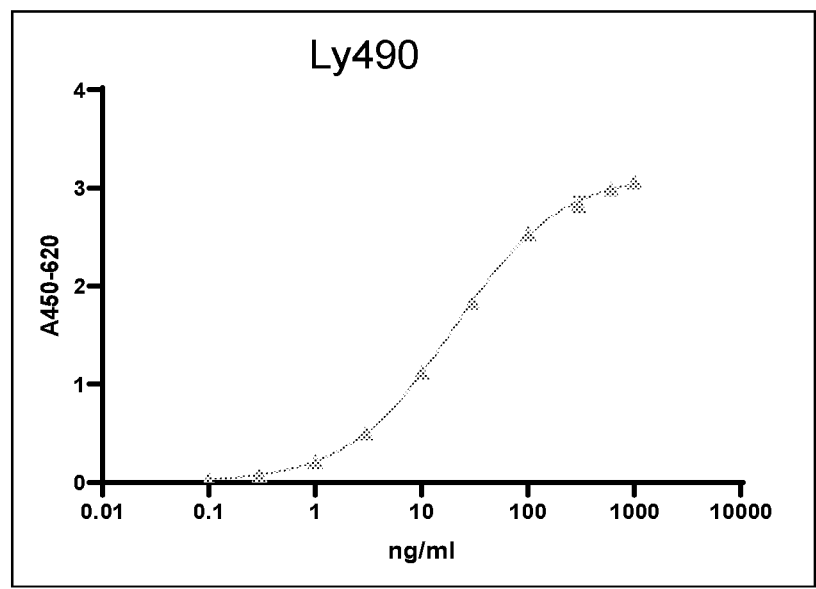
Figure 21E:
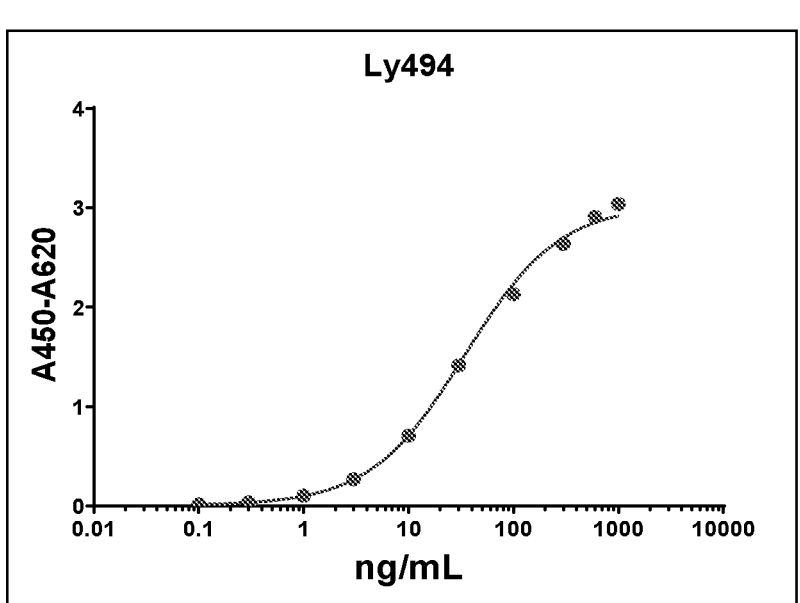
Figure 21F:
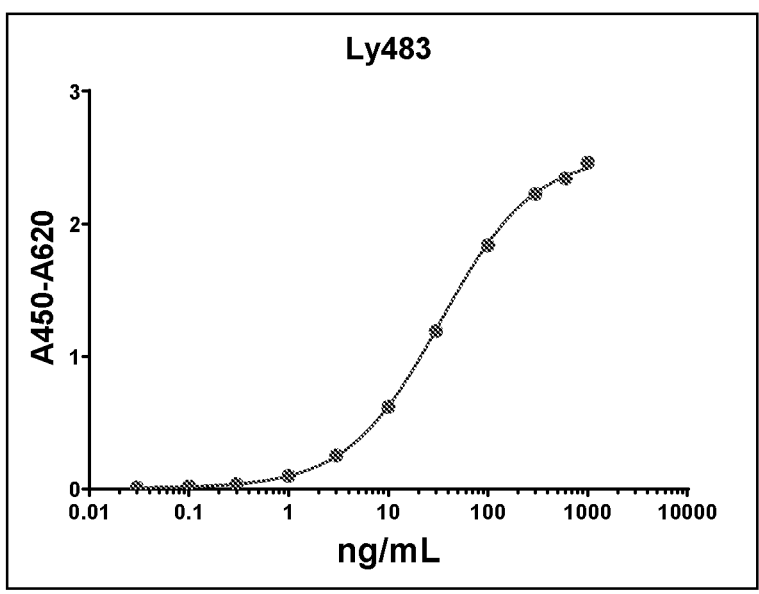
Figure 21G:
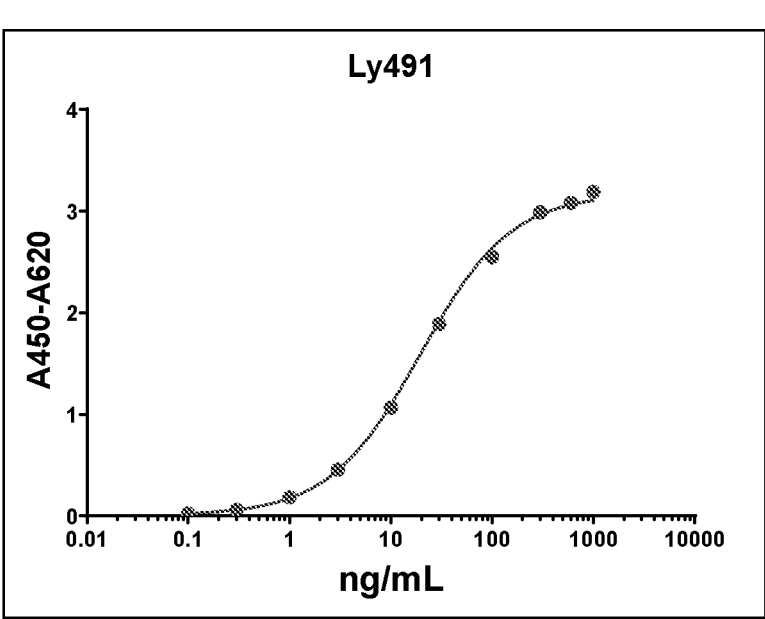
Figure 21H:
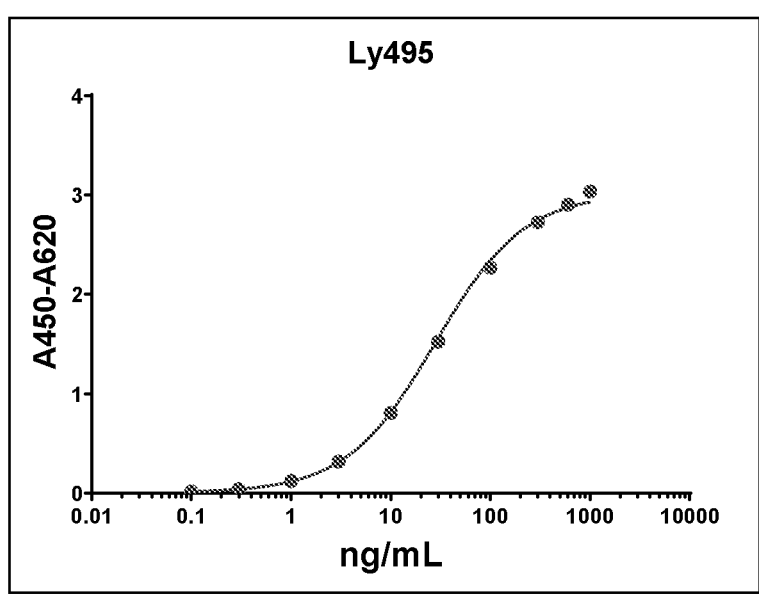
Figure 21I:
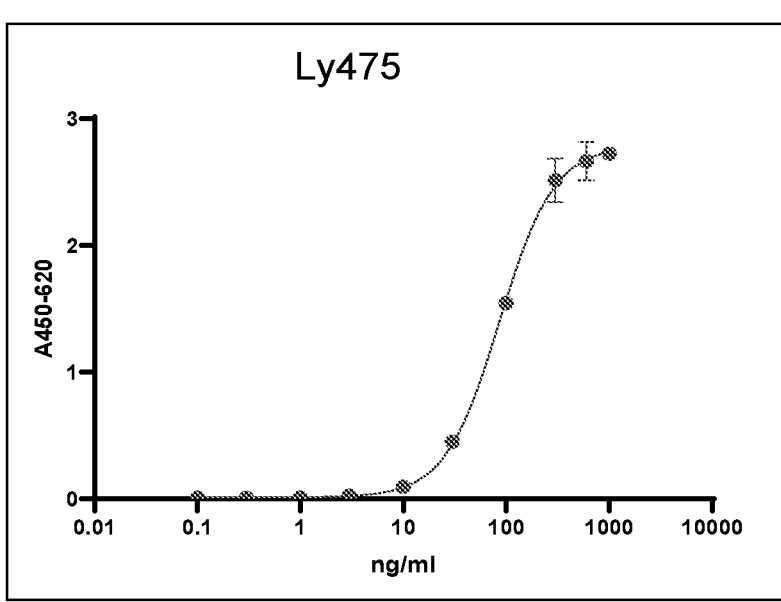
Figure 21J:
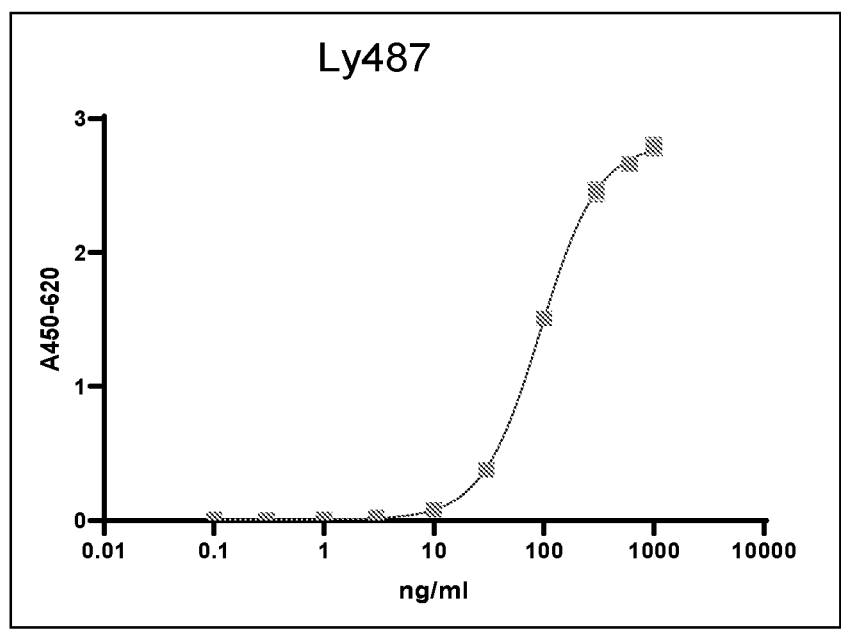
Figure 22A:
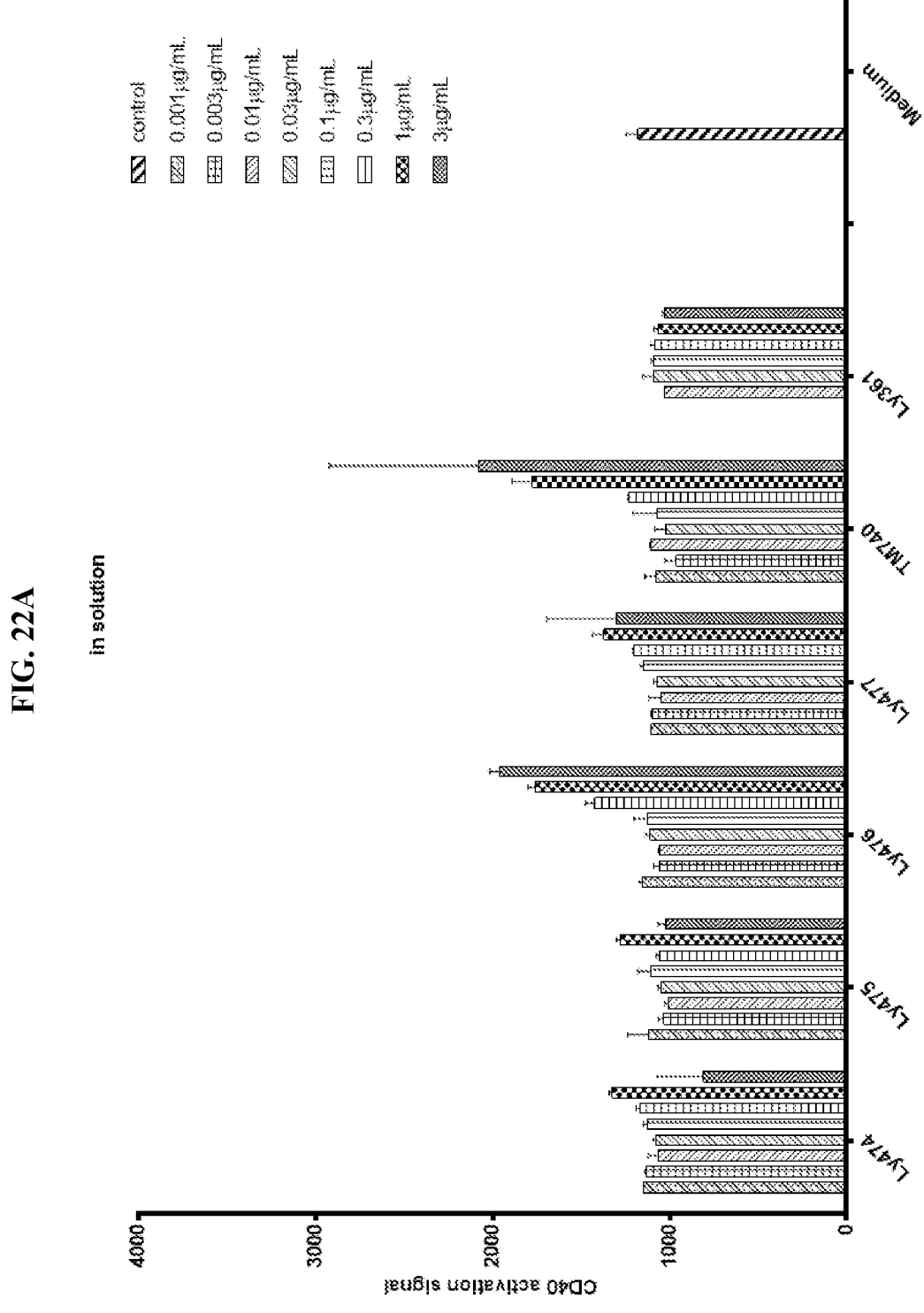
Figure 22B:
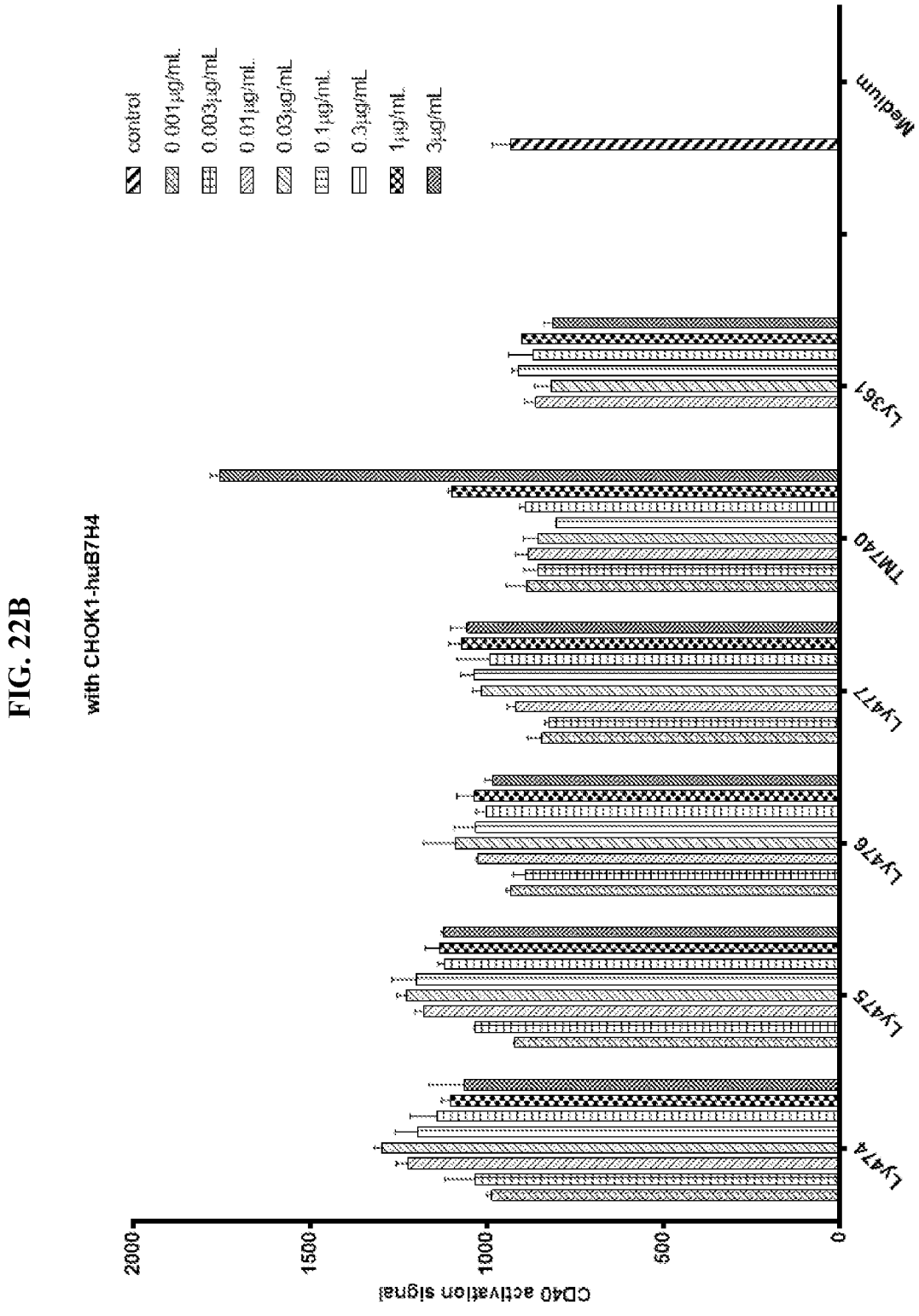
Figure 22C:
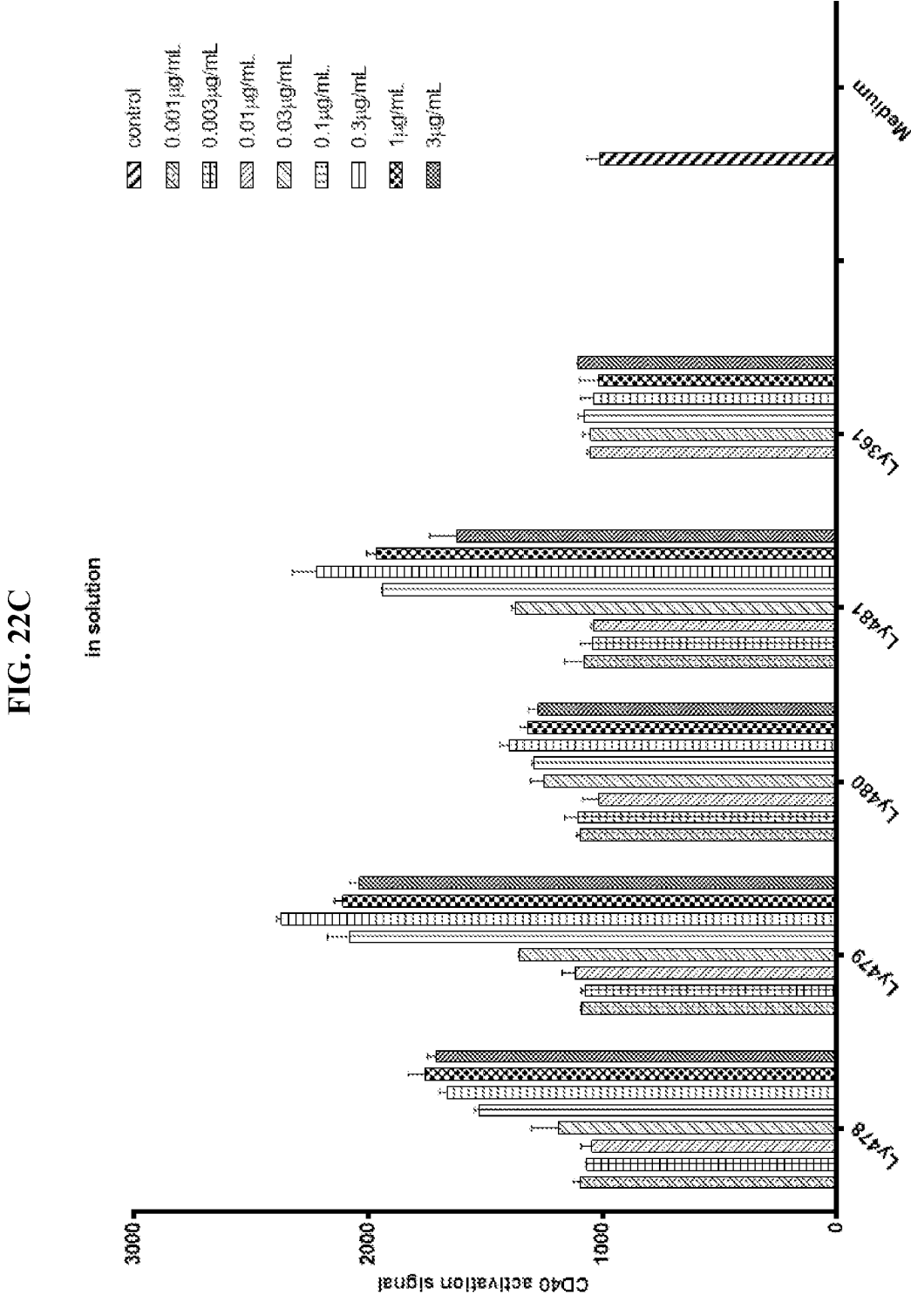
Figure 22D:
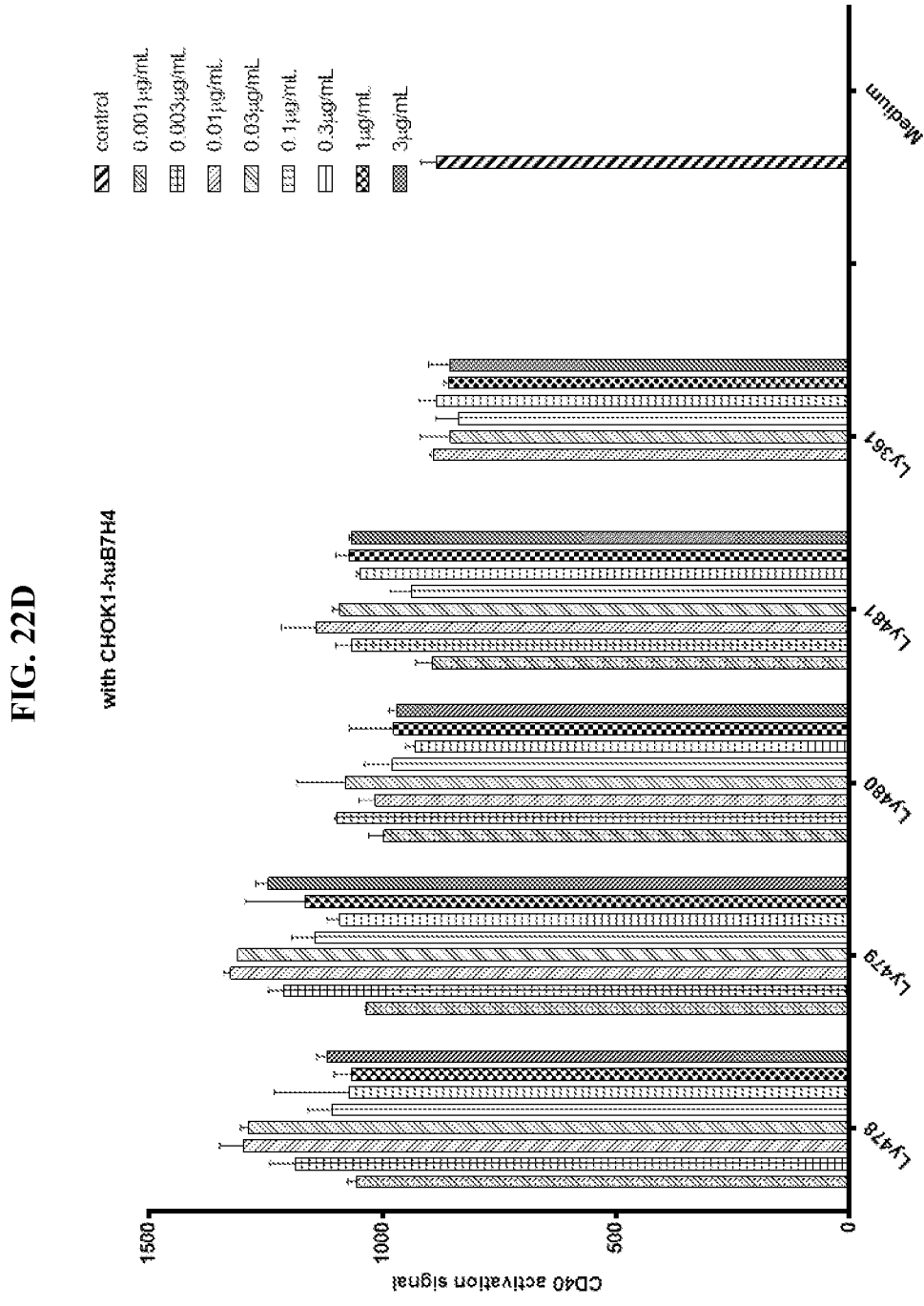
Figure 22F:
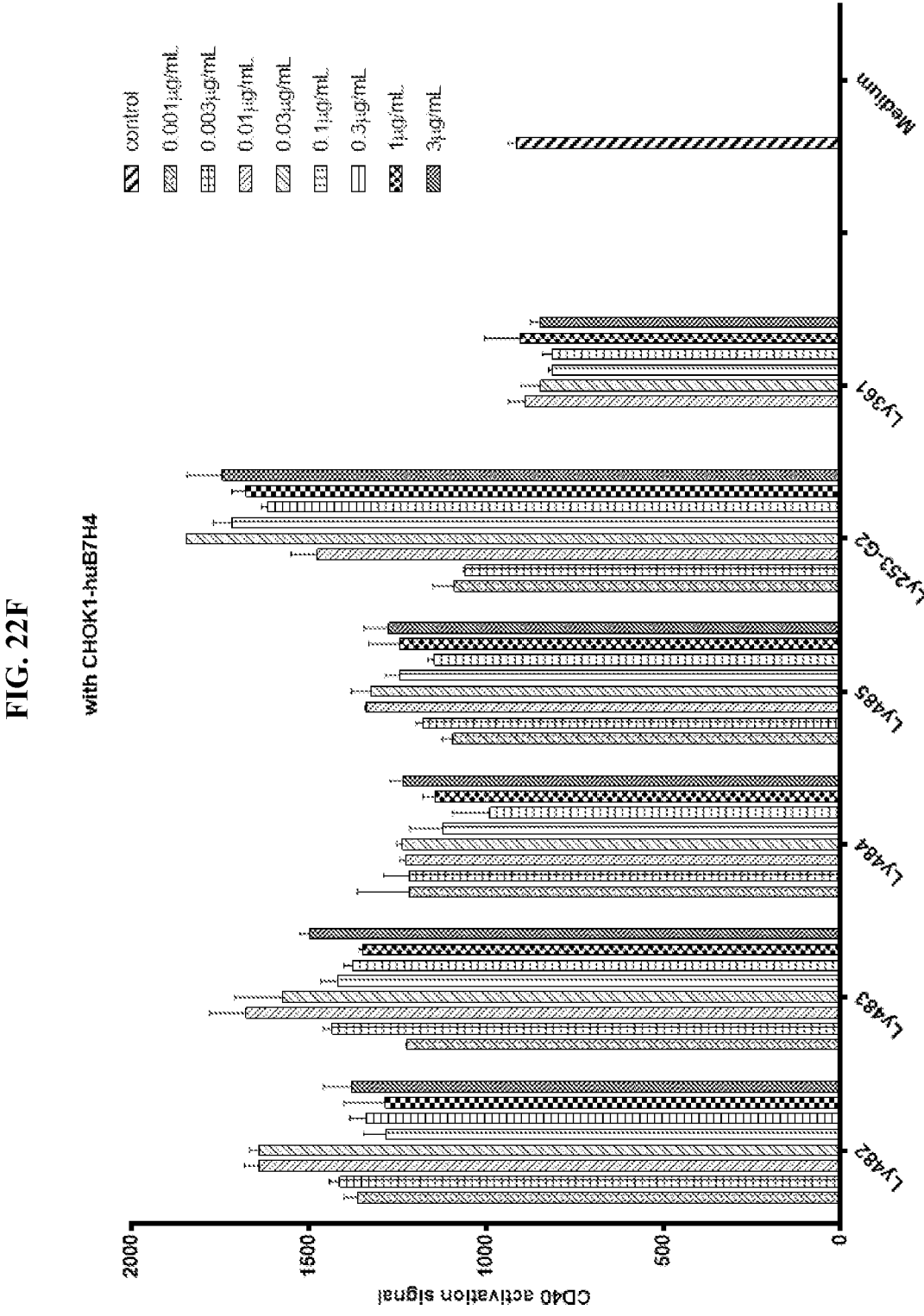
Figure 22G:
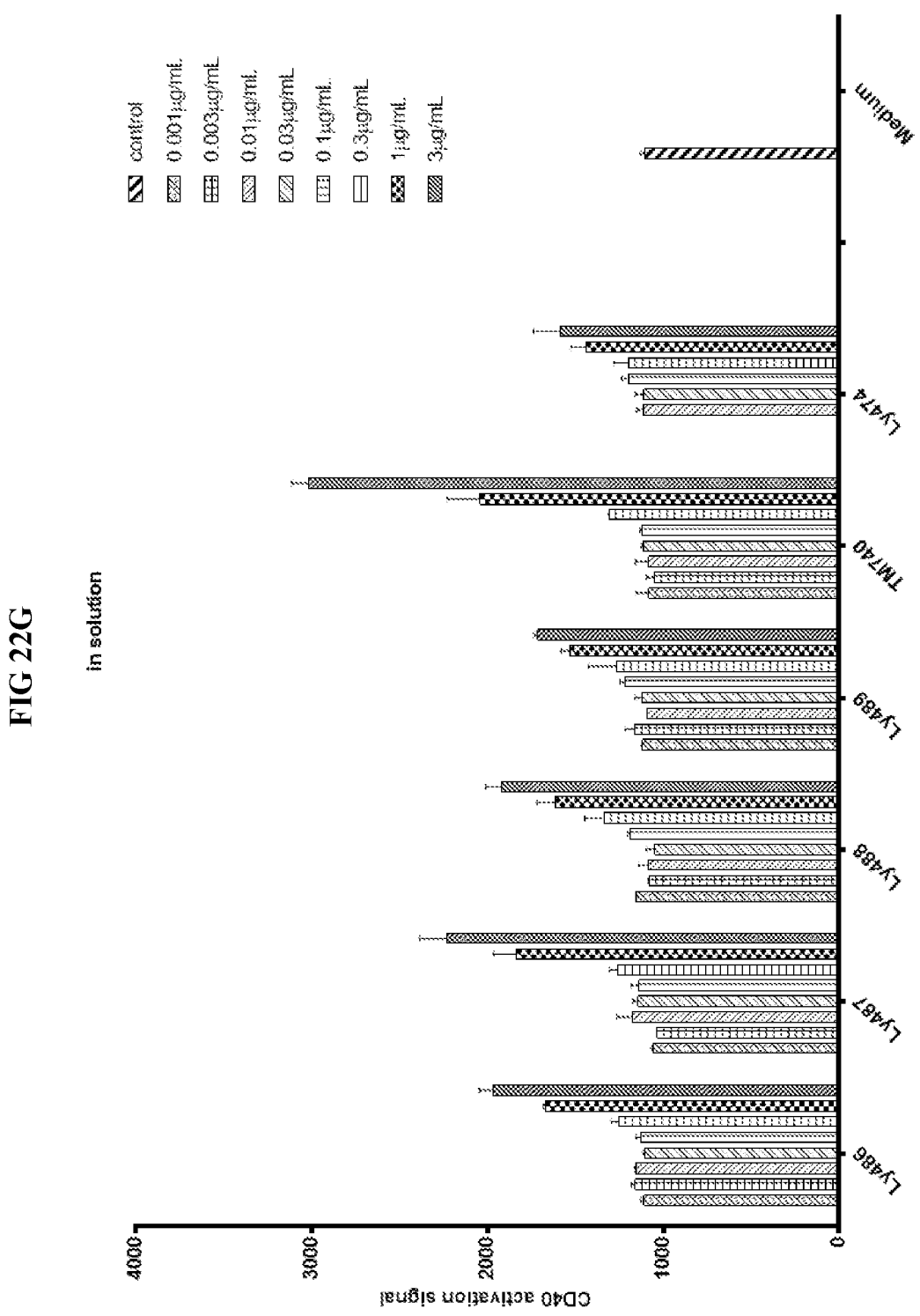
Figure 22I:
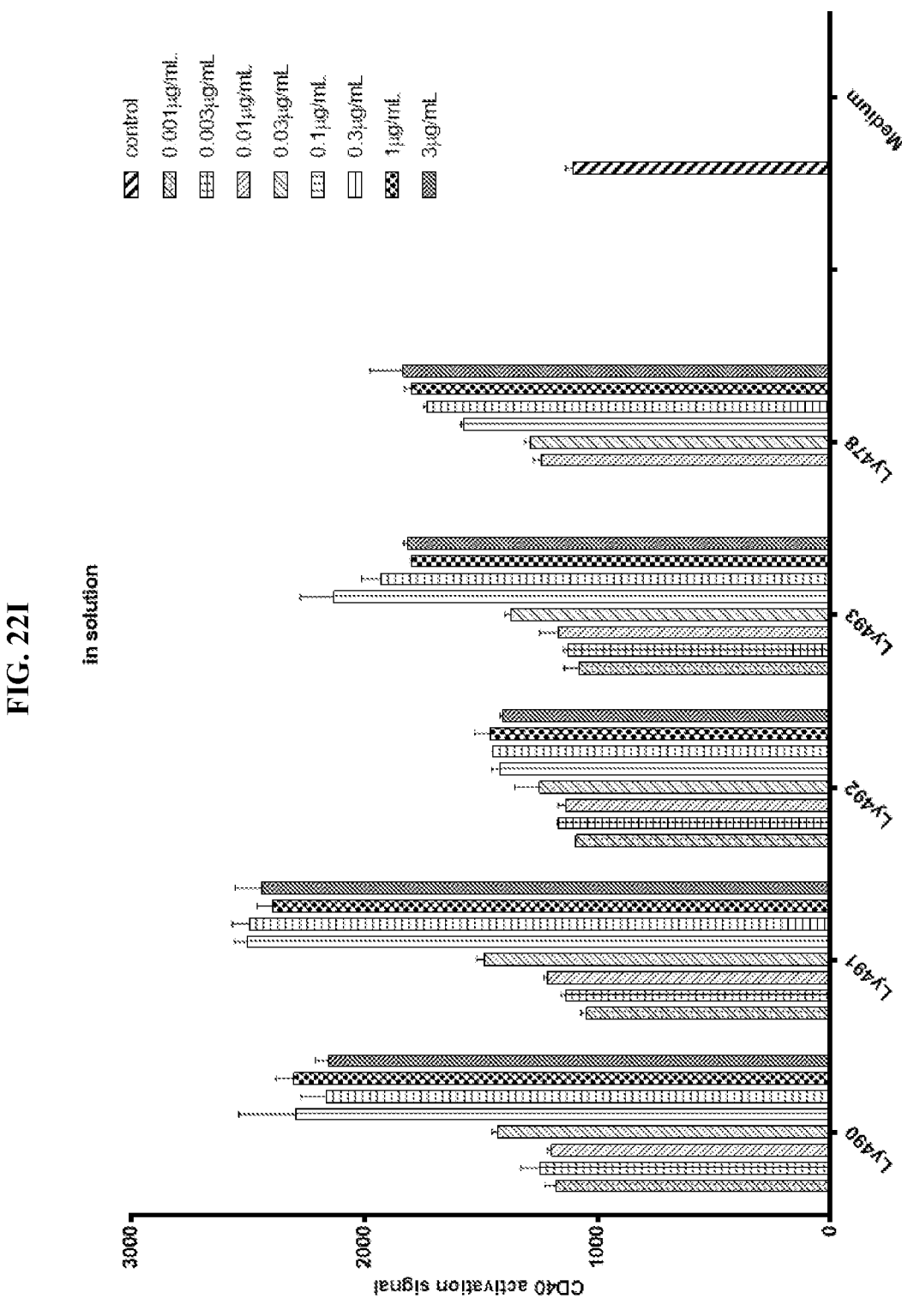
Figure 22J:
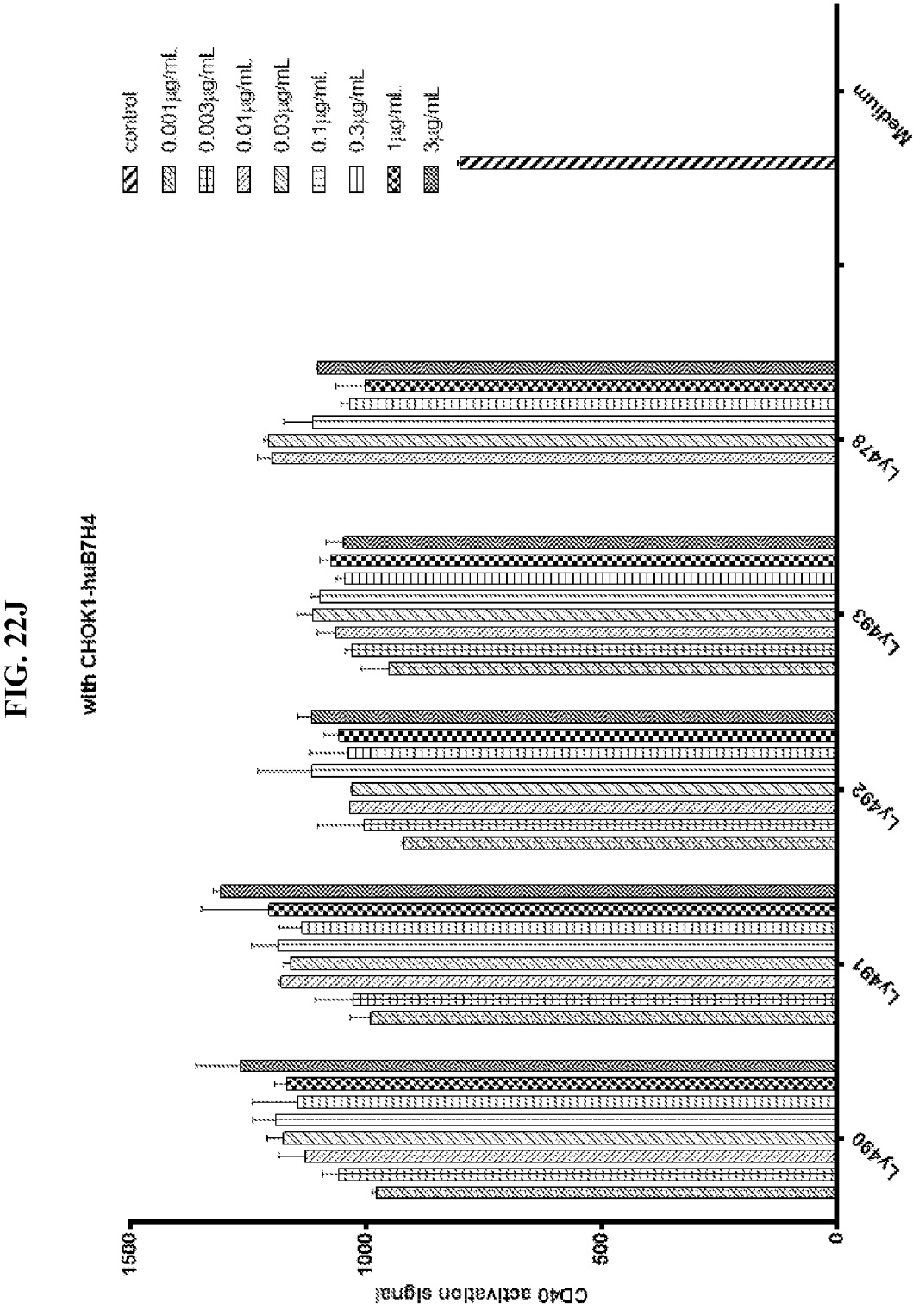
Figure 22L:
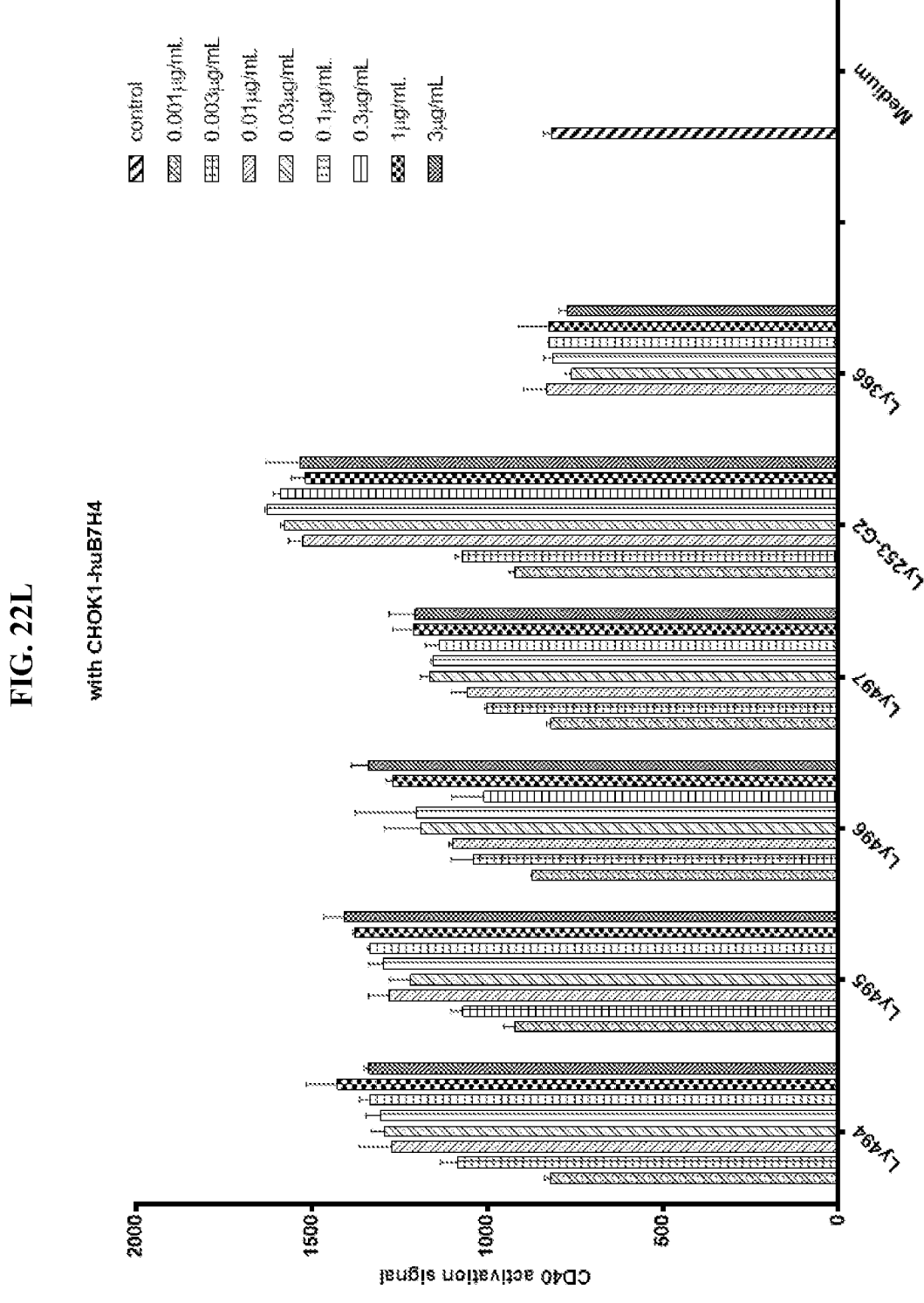

FIG. 18 is a chart showing serum alanine transaminase (ALT, a liver enzyme released into serum upon liver damage) level after treatment of antibodies as shown in homozygous B-hCD40 C57BL6 mice.

FIGS. 19A-19D are charts showing B7H4 binding activity of anti-B7H4/CD40 antibodies as indicated on the x-axis to human B7H4 expressed on CHO cells. The bars ("IgG control") served as controls. Binding of these anti-B7H4/CD40 antibodies are indicated by the mean fluorescence intensity (MFI) on the y-axis. 19A: Clones Ly474-Ly479 and Ly361. 19B: Clones Ly480-Ly485 and Ly361. 19C: Clones Ly486-Ly491 and Ly366. 19D: Clones Ly492-497 and Ly366.

FIGS. 20A-20D are charts showing CD40 binding activity of anti-B7H4/CD40 antibodies as indicated on the x-axis to human CD40 expressed on CHO cells. Ly361 and Ly366 served as controls. Binding of these anti-B7H4/CD40 antibodies are indicated by the mean fluorescence intensity (MFI) on the y-axis. 20A: Clones Ly474-479 and TM740. 20B: Clones Ly480-485 and TM740. 20C: Clones Ly486-Ly491 and TM740. 20D: Clones Ly492-Ly497 and TM740.

FIGS. 21A-21J are charts showing simultaneously binding of exemplary anti-B7H4/CD40 antibodies to recombinant human B7H4 and CD40 proteins. Clones Ly479 (21A), Ly478 (21B), Ly482 (21C), Ly490 (21D), Ly494 (21E), Ly483 (21F), Ly491 (21G), Ly495 (21H), Ly475 (21I) and Ly487 (21J) at various concentrations as indicated.

Figure 22E:
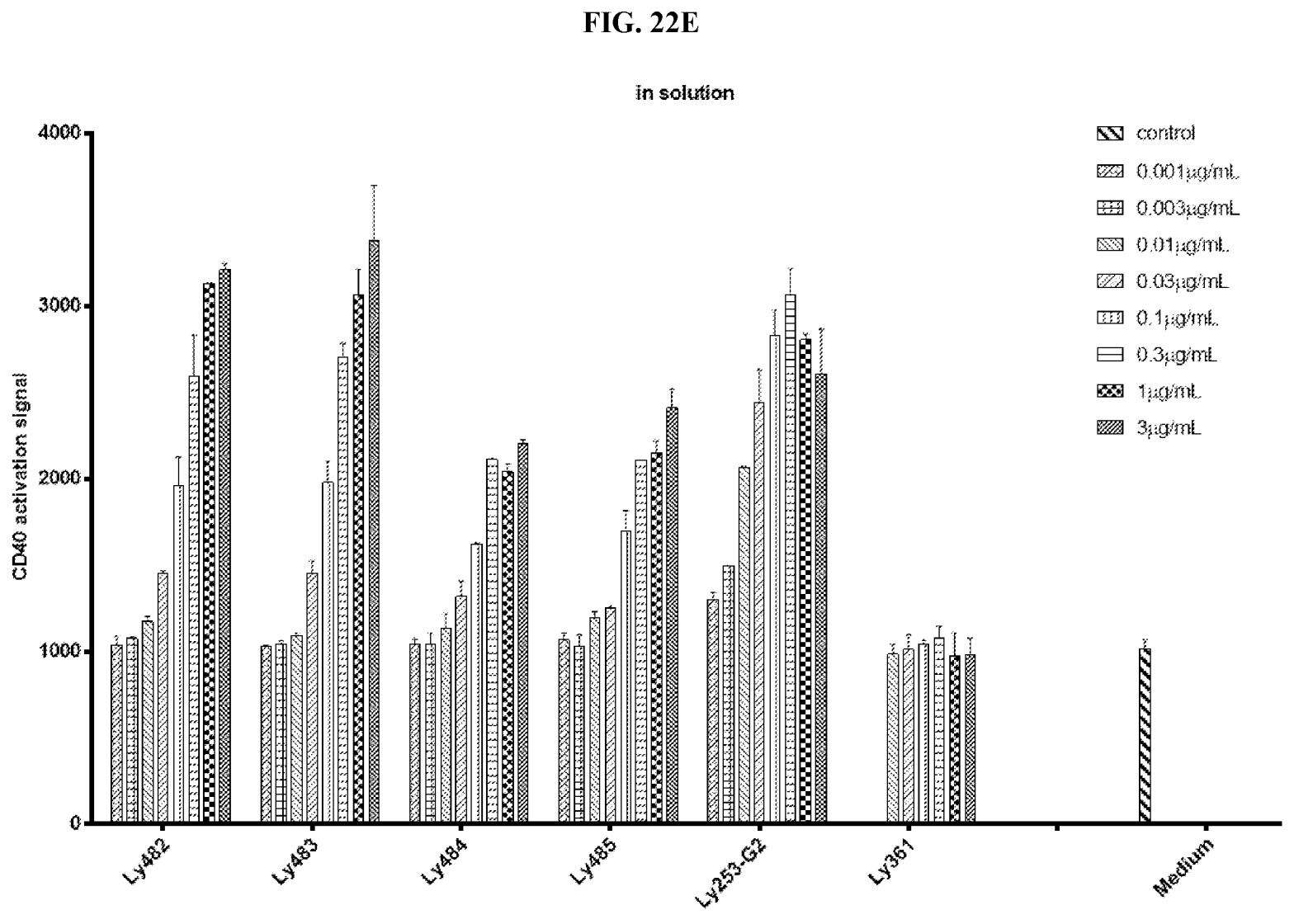
Figure 22H:
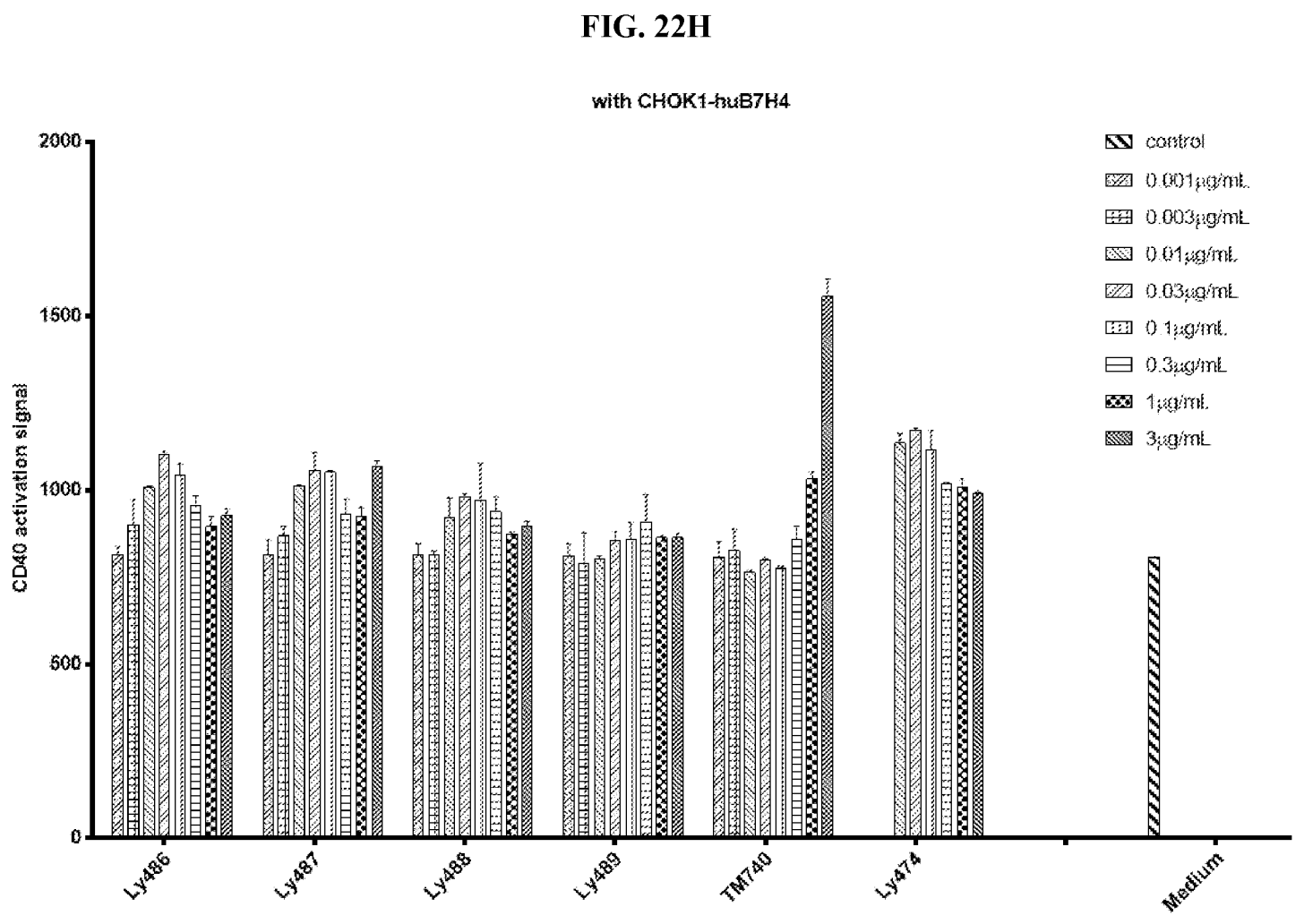
Figure 22K:
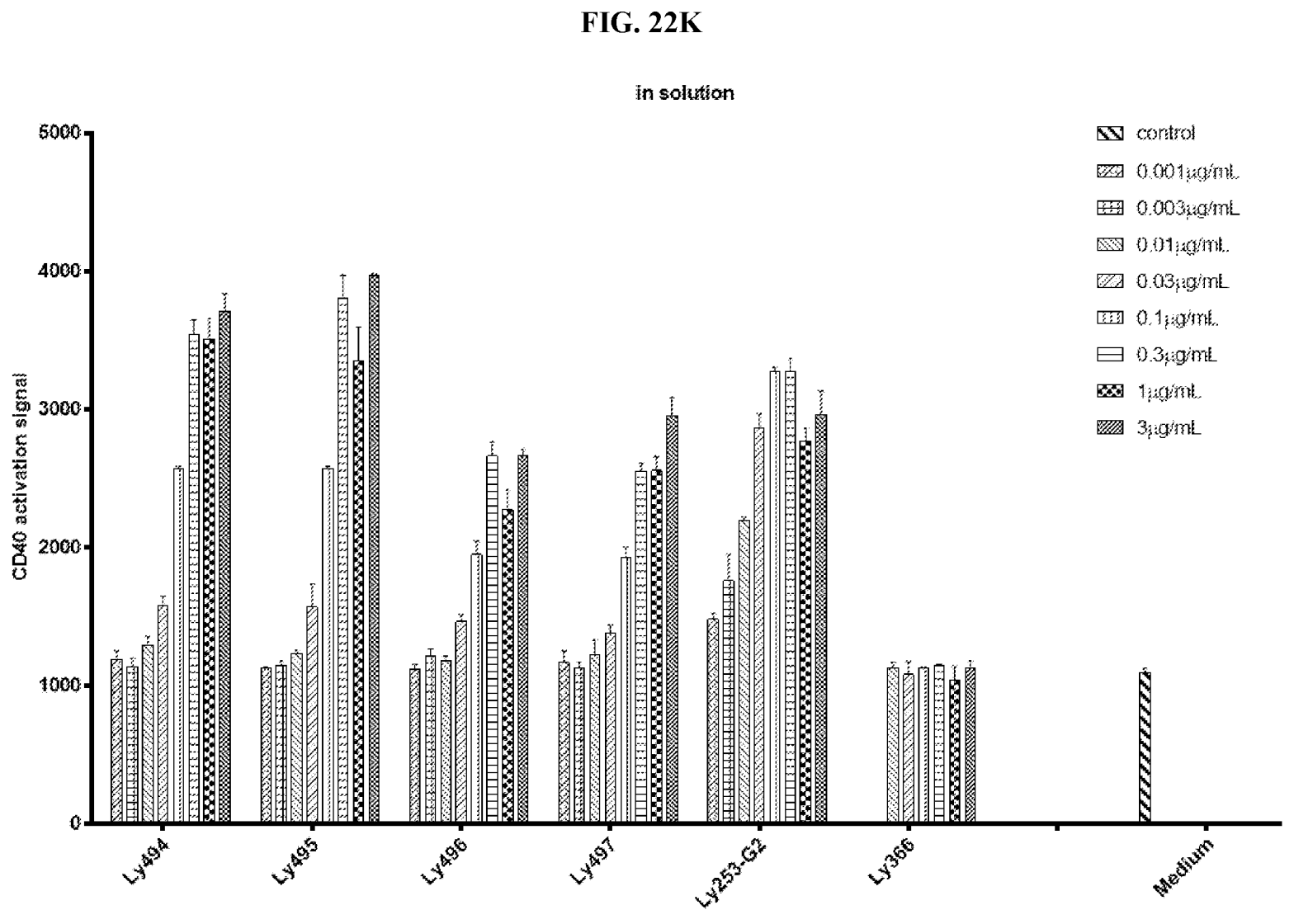

FIGS. 22A-22L are charts showing stimulation of human CD40 activation as indicated by IL8 secretion, in a reporter assay by a number of anti-B7H4/CD40 antibodies. The agonistic activity of these bispecific antibodies was evaluated either in solution, or co-cultured with B7H4 overexpressing CHO cells. The various antibodies are indicated on the x-axis, and the CD40 activation signal are indicated on the y-axis. 22A: Clones Ly474-Ly477, TM740 and Ly361 at various concentrations as indicated for activating CD40 in solution. 22B: Clones Ly474-Ly477, TM740 and Ly361 at various concentrations as indicated for activating CD40 when cocultured with B7H4 overexpressing CHO-K1 cells. 22C: Clones Ly478-Ly481 and Ly361 at various concentrations as indicated for activating CD40 in solution. 22D: Clones Ly478-Ly481 and Ly361 at various concentrations as indicated for activating CD40 when cocultured with B7H4 overexpressing CHO-K1 cells. 22E: Clones Ly482-Ly485, Ly253-G2 and Ly361 at various concentrations as indicated for activating CD40 in solution. 22F: Ly482-Ly485, Ly253-G2 and Ly361 at various concentrations as indicated for activating CD40 when cocultured with B7H4 overexpressing CHO-K1 cells. 22G: Clones Ly486-Ly489, TM740 and Ly474 at various concentrations as indicated for activating CD40 in solution. 22H: Clones Ly486-Ly489, TM740 and Ly474 at various concentrations as indicated for activating CD40 when cocultured with B7H4 overexpressing CHO-K1 cells. 22I: Clones Ly490-Ly493 and Ly478 at various concentrations as indicated for activating CD40 in solution. 22J: Clones Ly490-Ly493 and Ly478 at various concentrations as indicated for activating CD40 when cocultured with B7H4 overexpressing CHO-K1 cells. 22K: Clones Ly494-Ly497, Ly253-G2 and Ly366 at various concentrations as indicated for activating CD40 in solution. 22L: Clones Ly494-Ly497, Ly253-G2 and Ly366 at various concentrations as indicated for activating CD40 when cocultured with B7H4 overexpressing CHO-K1 cells.

Figure 23A:
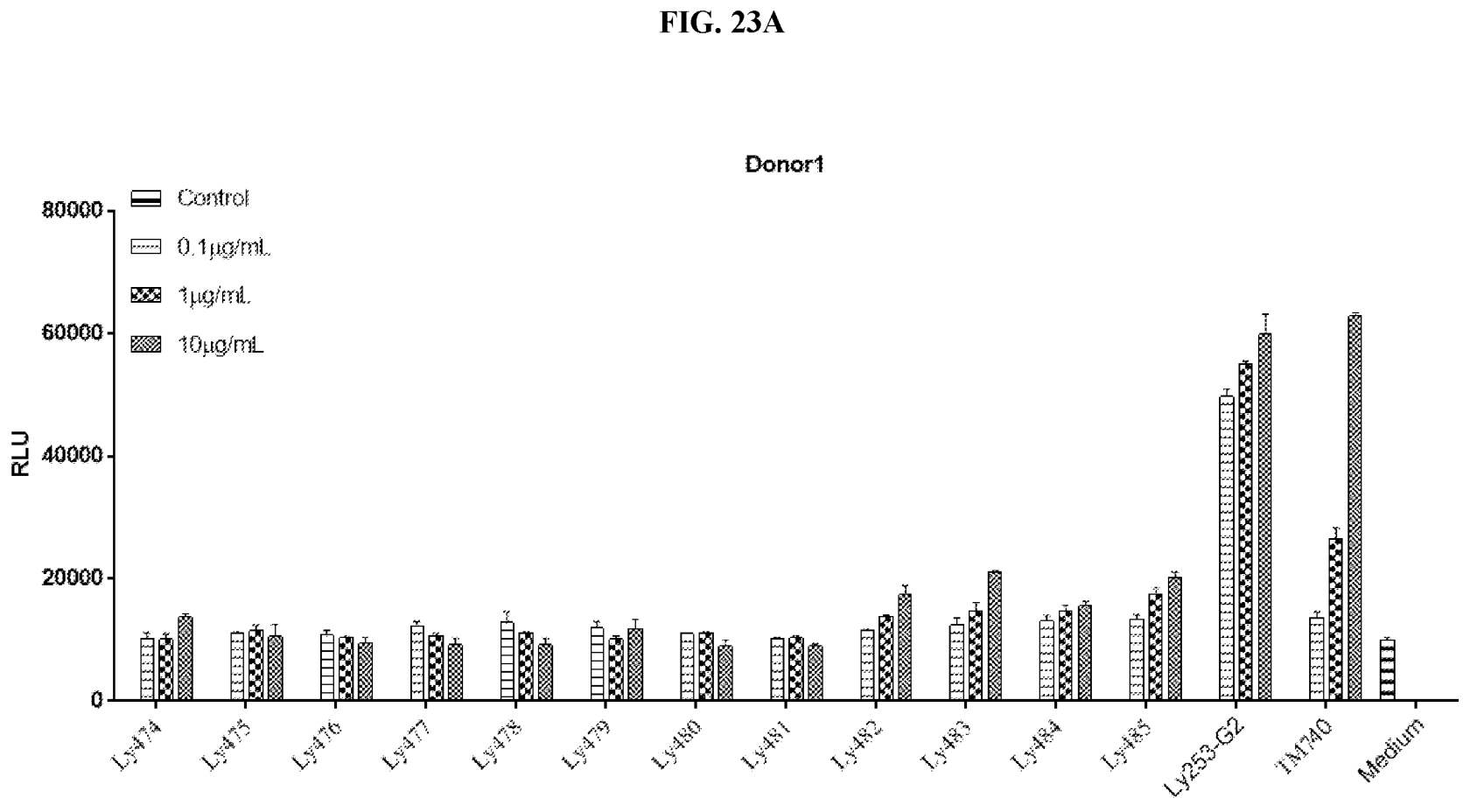
Figure 23B:
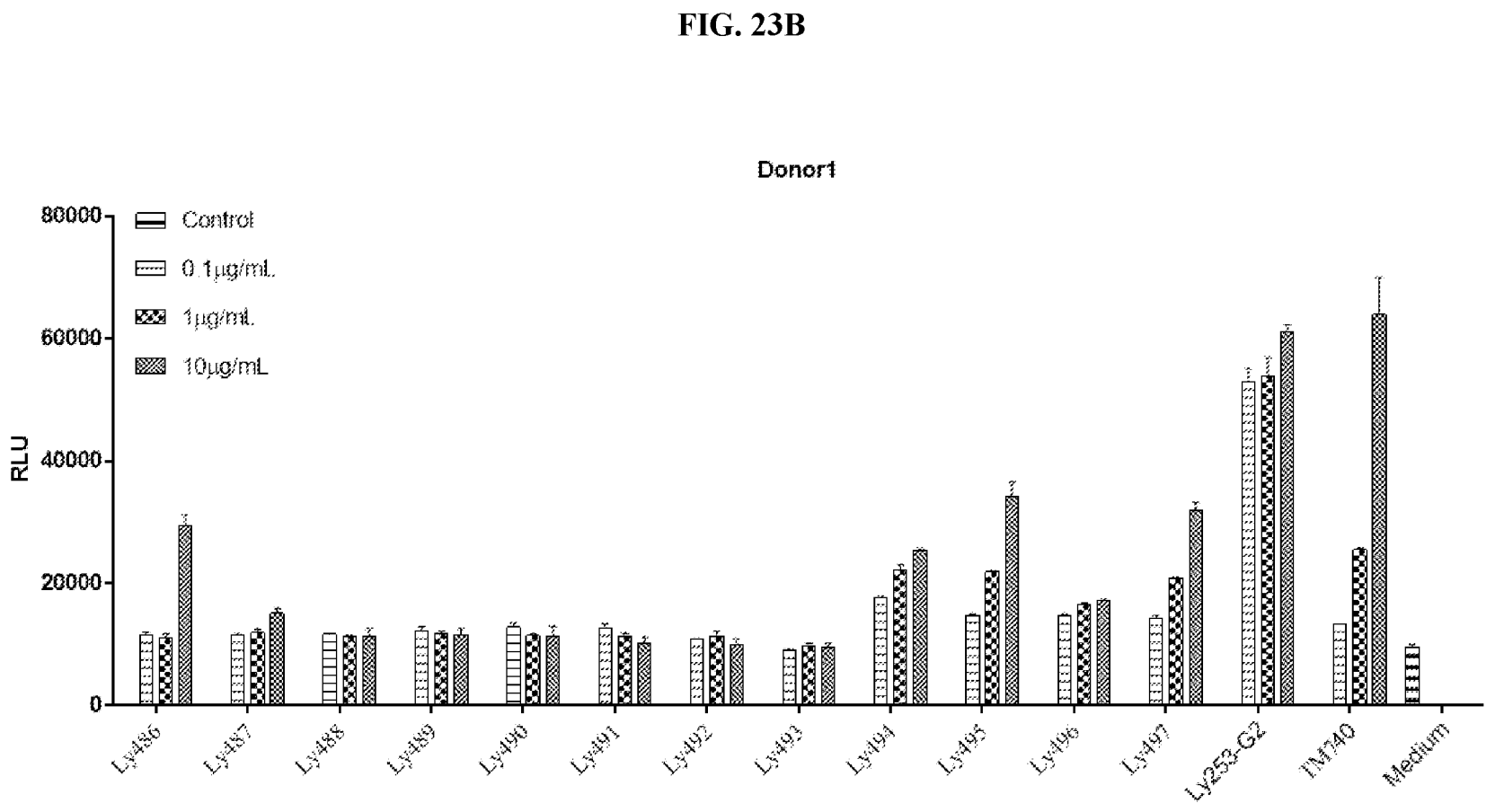
Figure 23C:
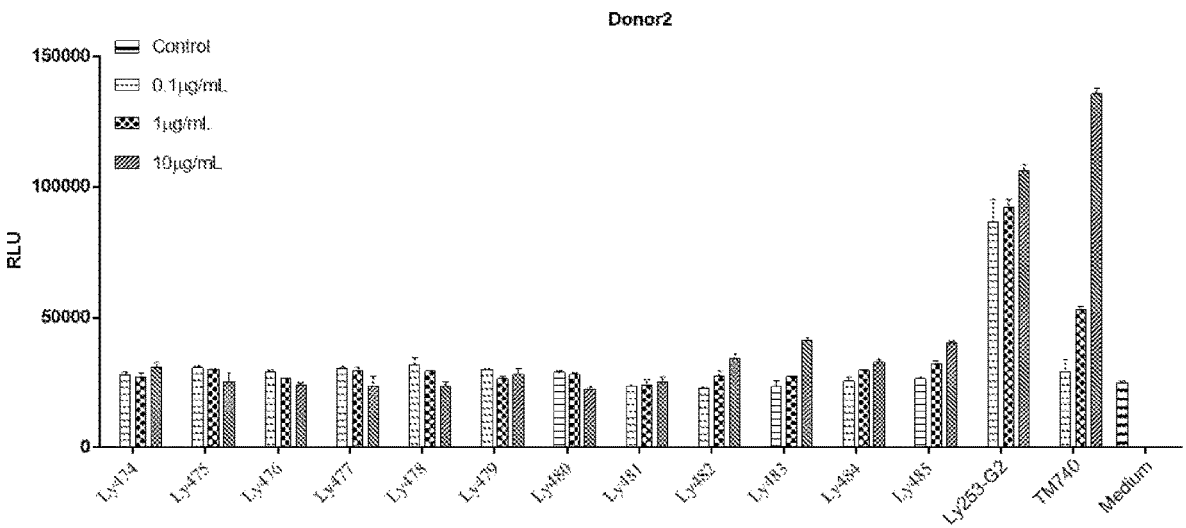
Figure 23D:
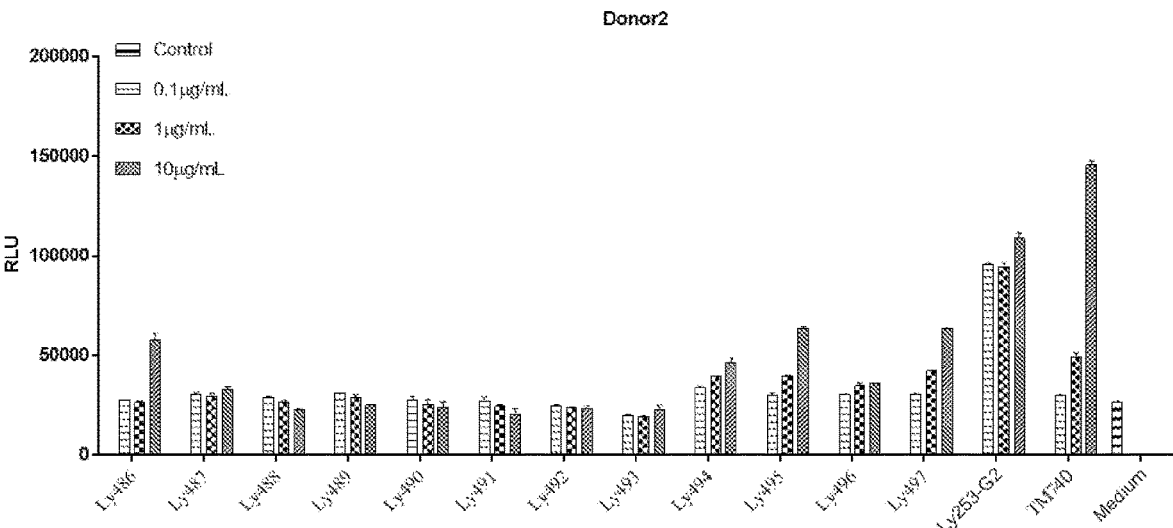
Figure 24A:
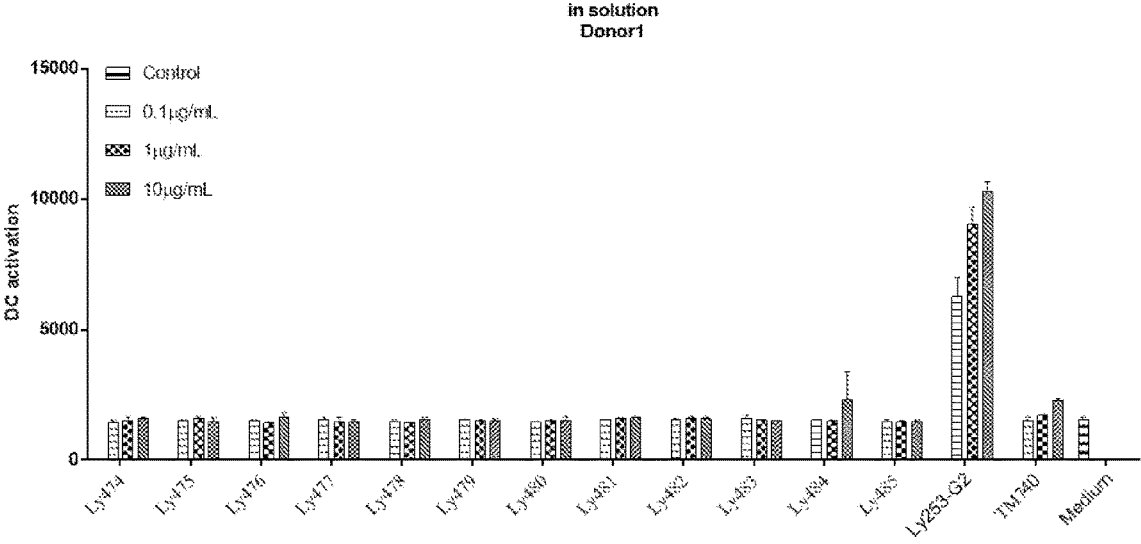
Figure 24B:
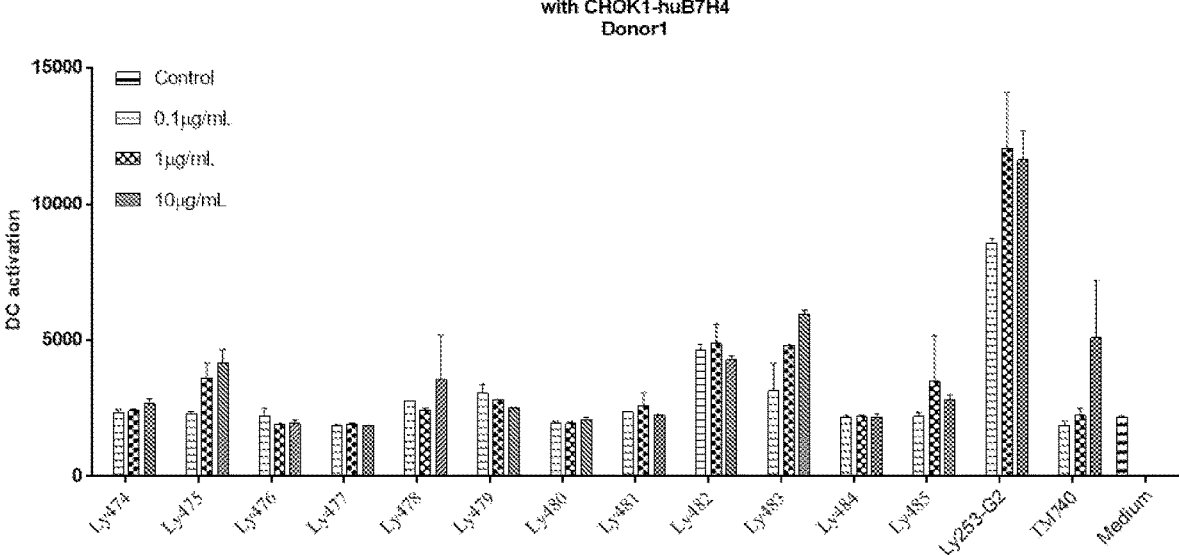
Figure 24C:
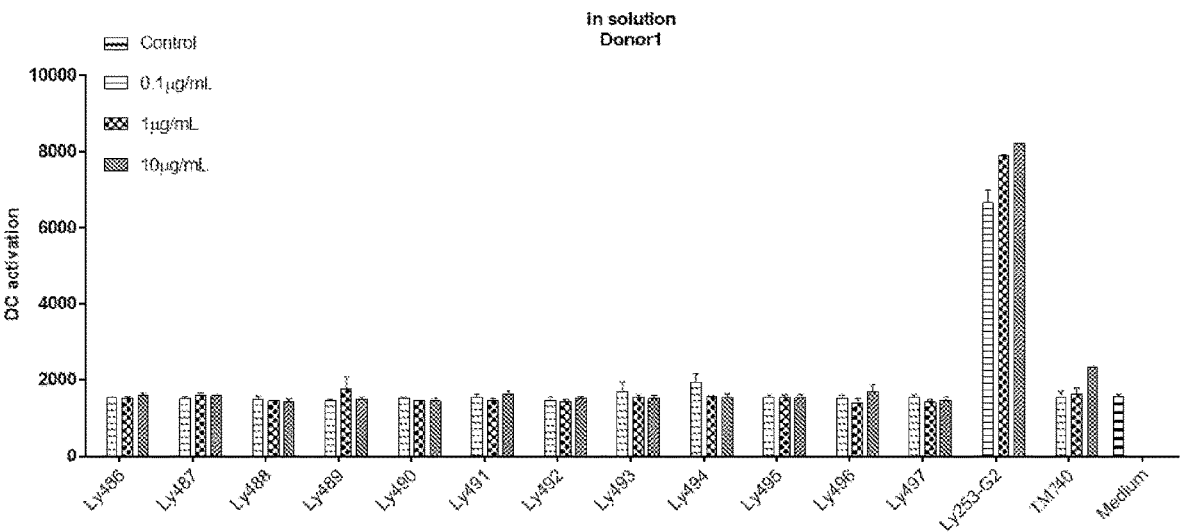
Figure 24D:
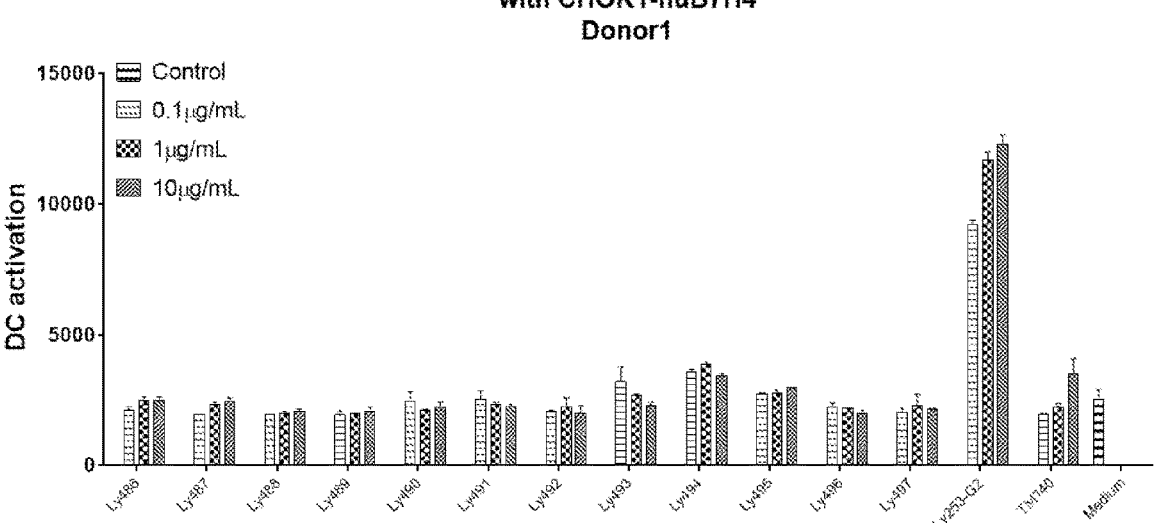
Figure 24E:
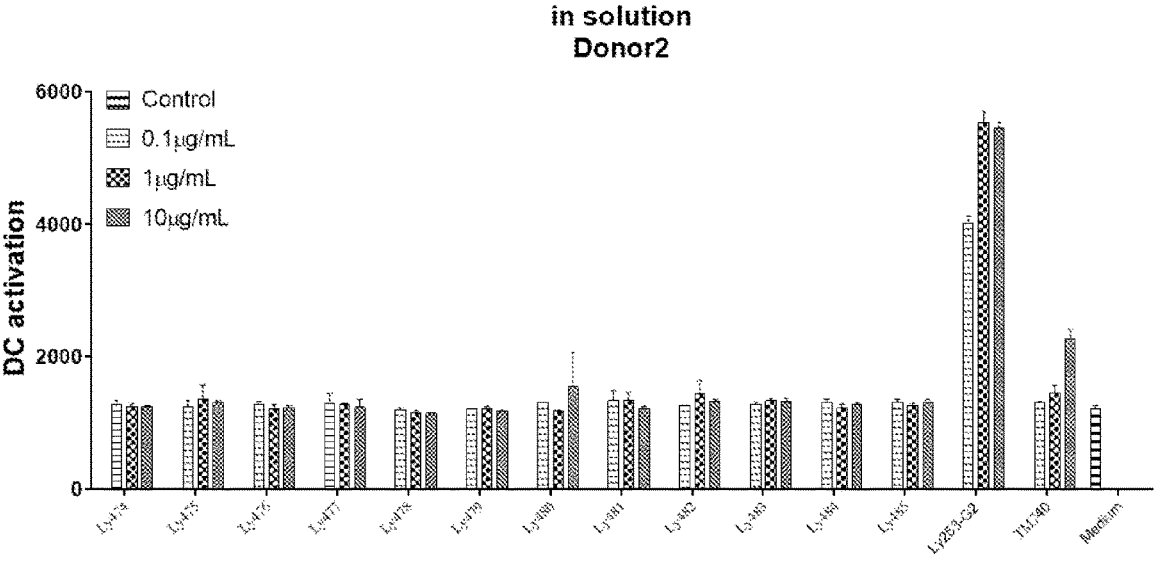
Figure 24F:
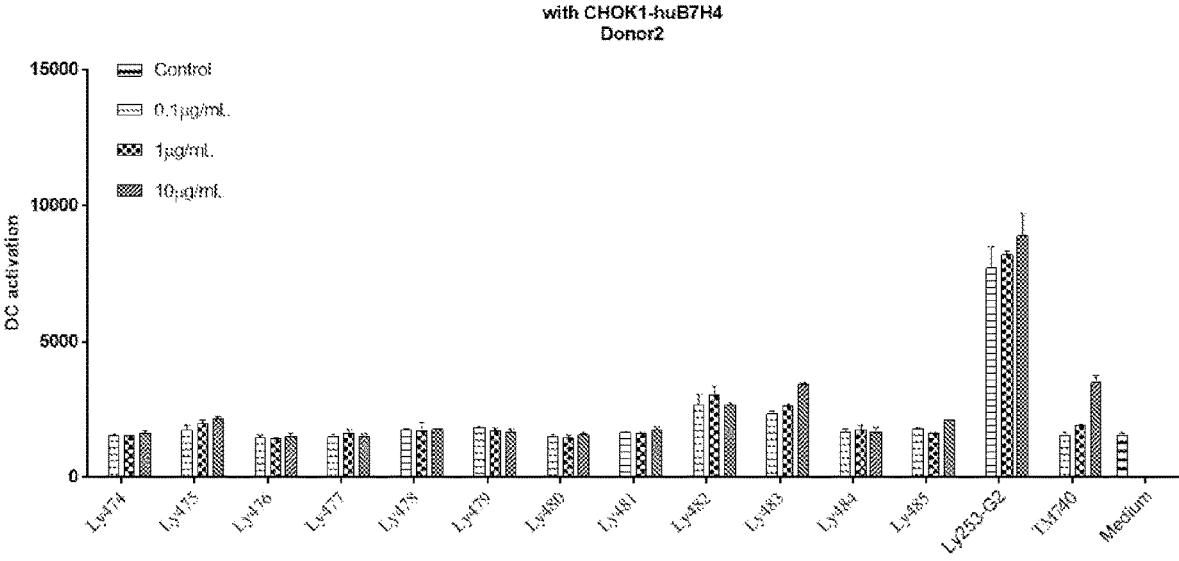
Figure 24G:
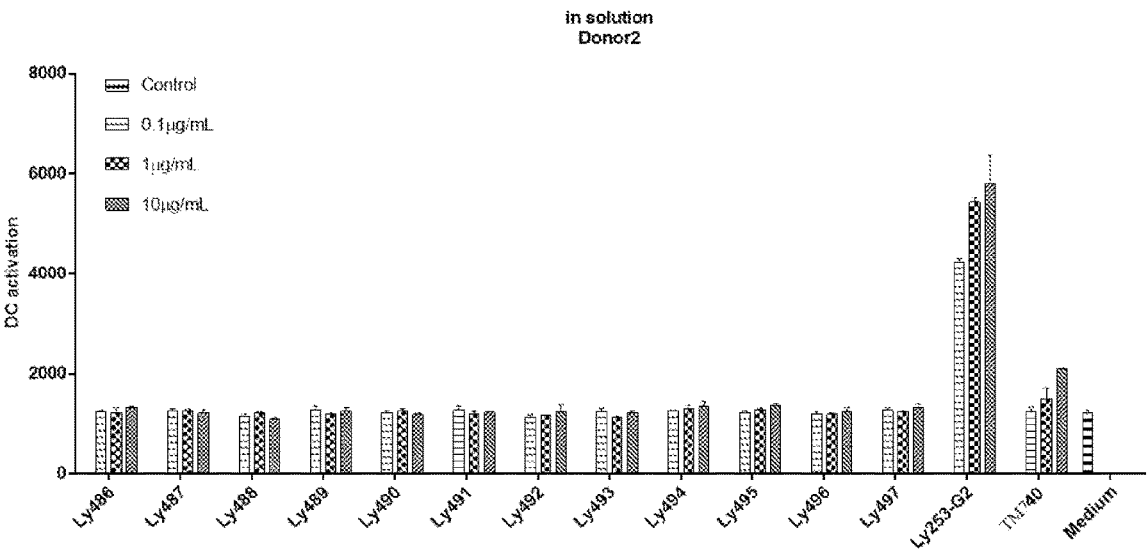
Figure 24H:
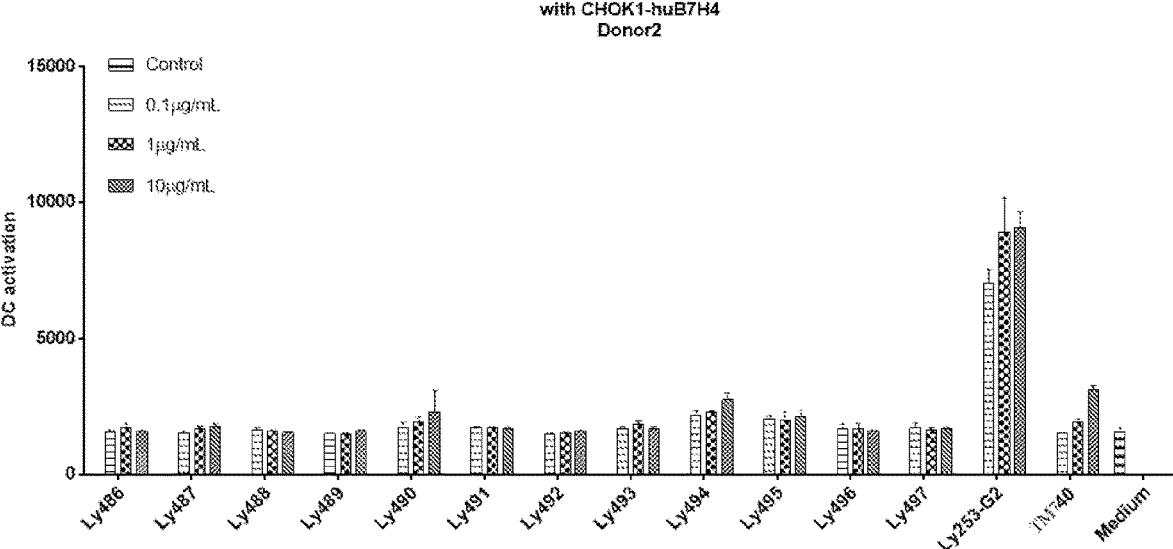
Figure 25A:
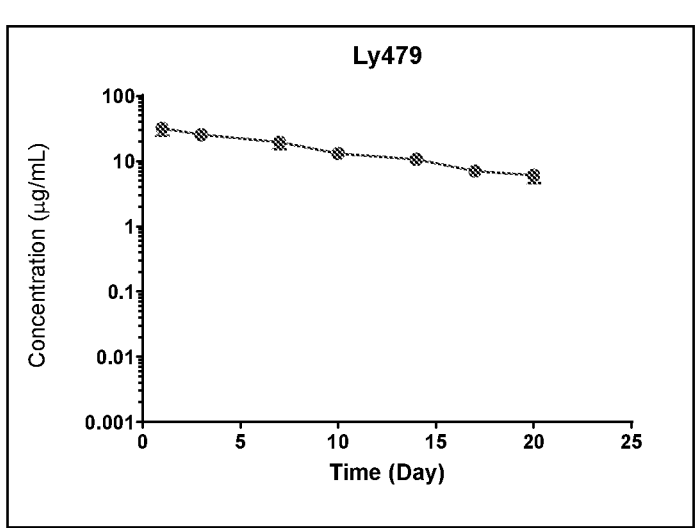
Figure 25B:
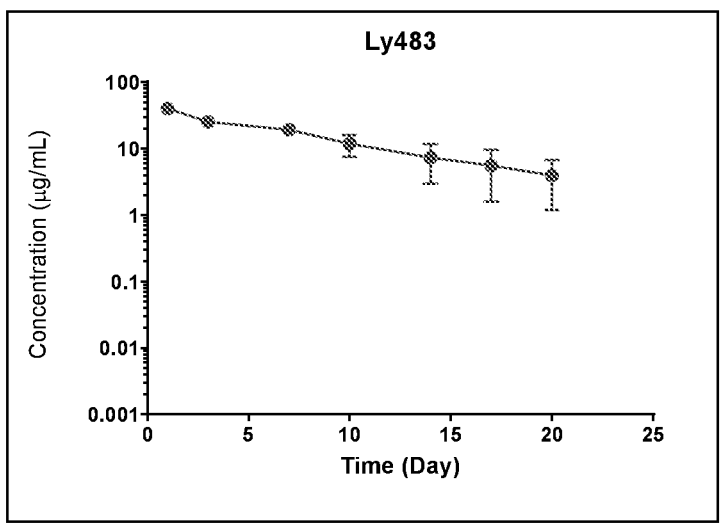
Figure 25C:
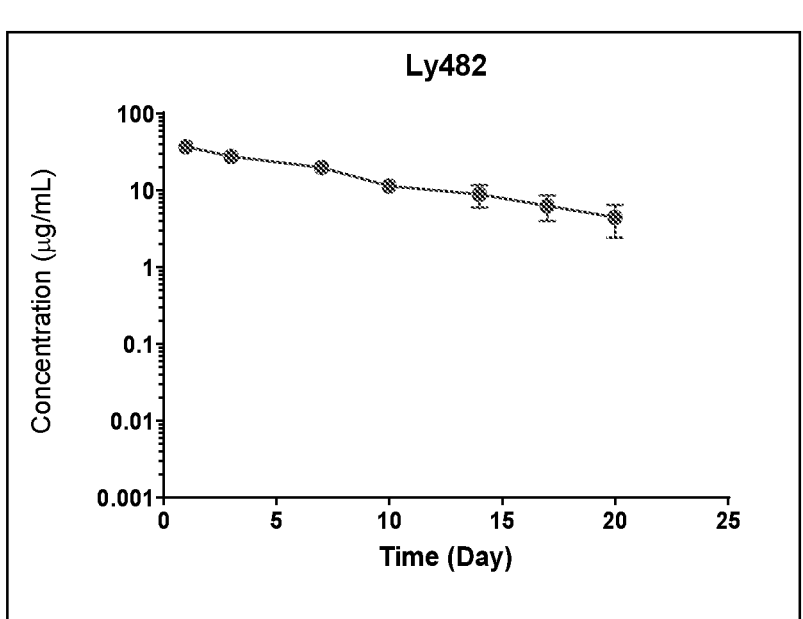
Figure 25D:
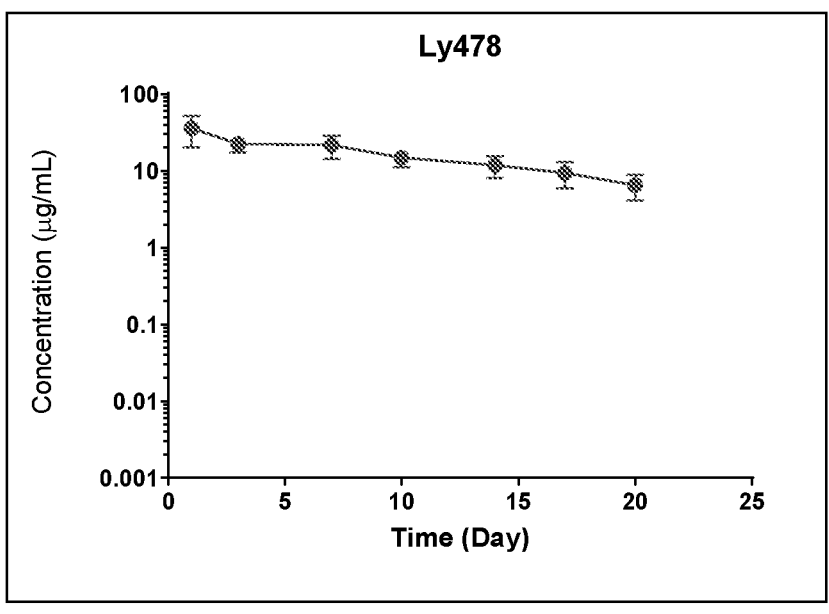
Figure 25E:
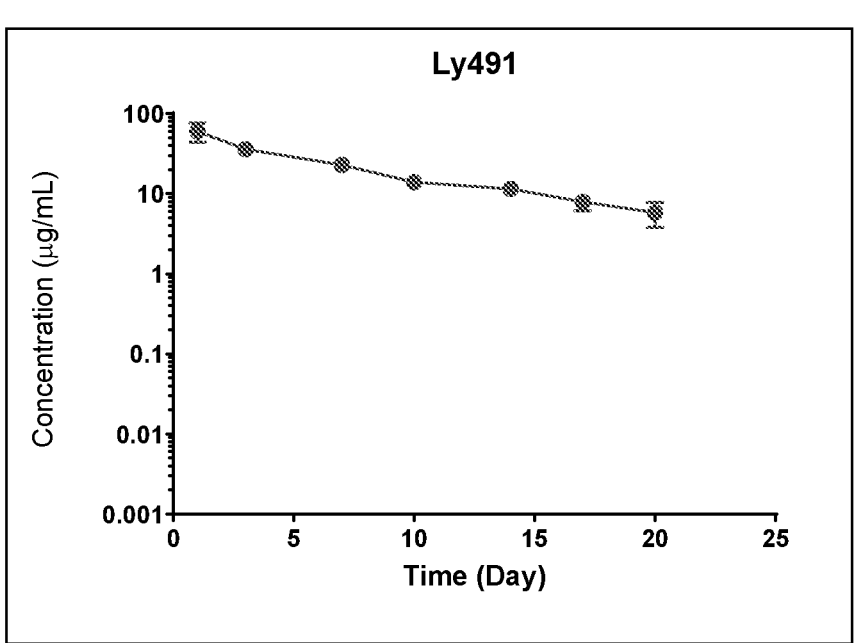
Figure 25F:
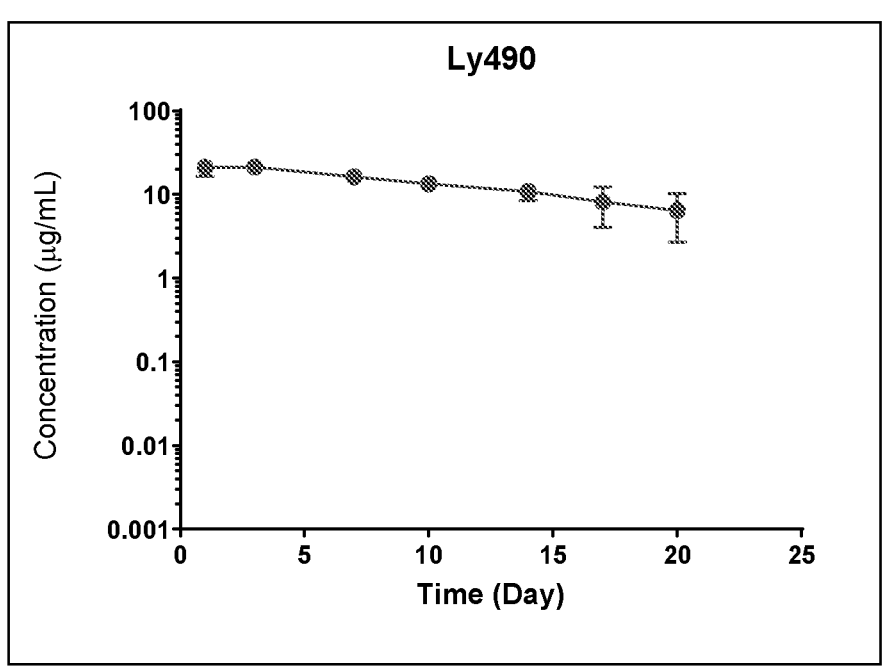
Figure 25G:
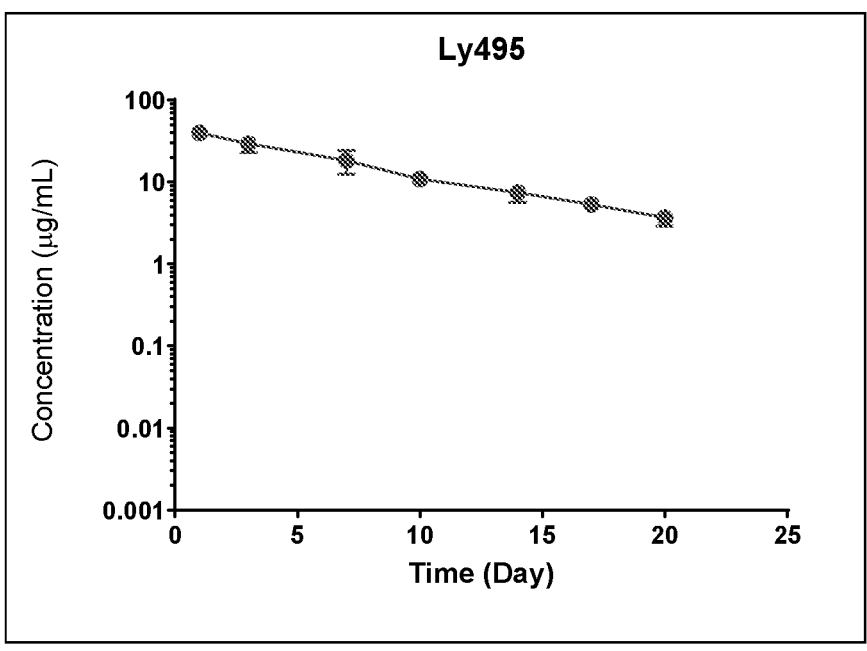
Figure 25H:
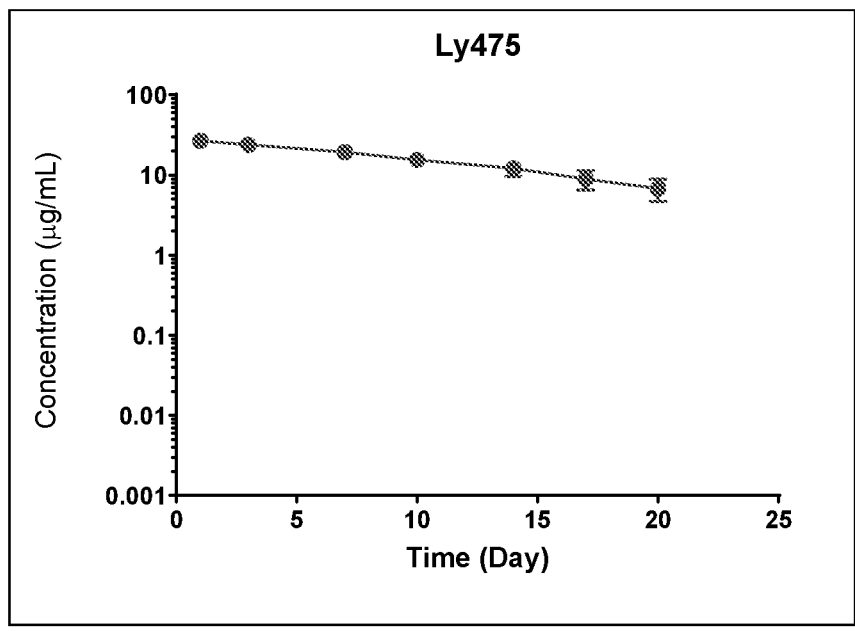
Figure 25I:
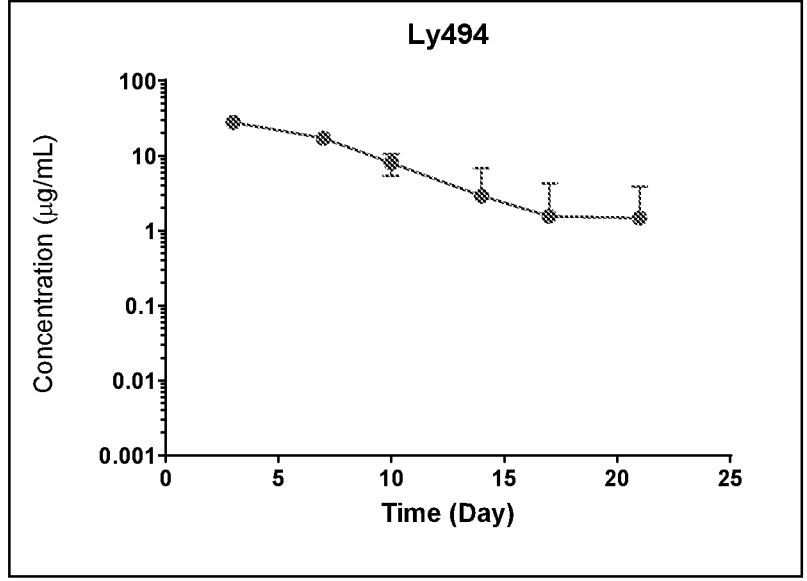
Figure 26A:
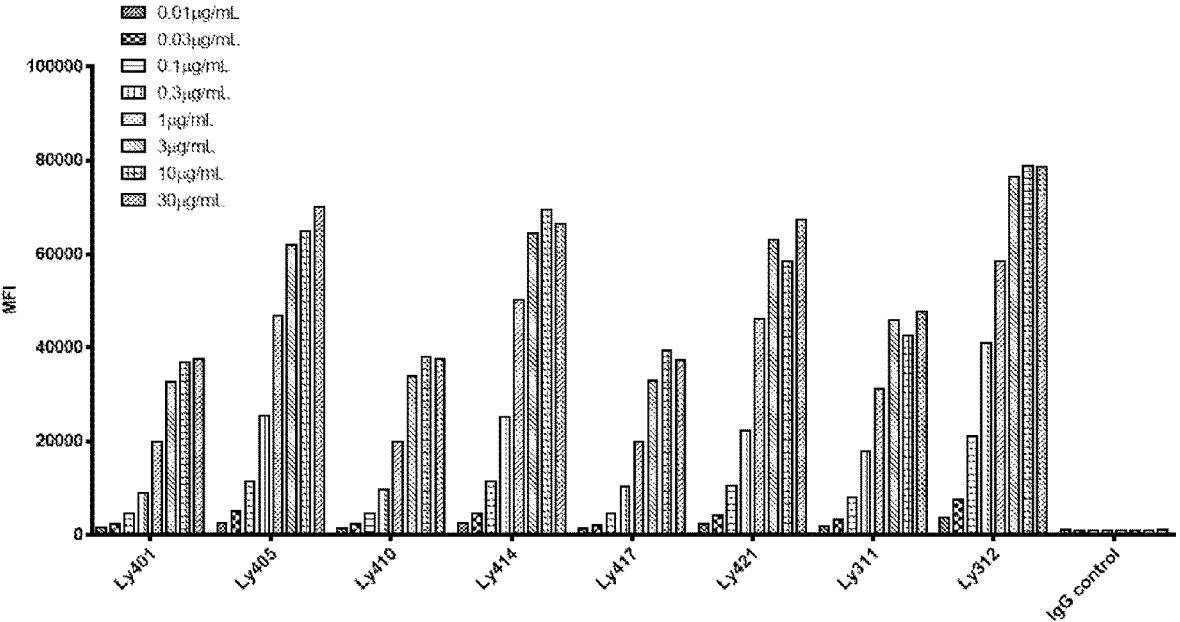
Figure 26B:
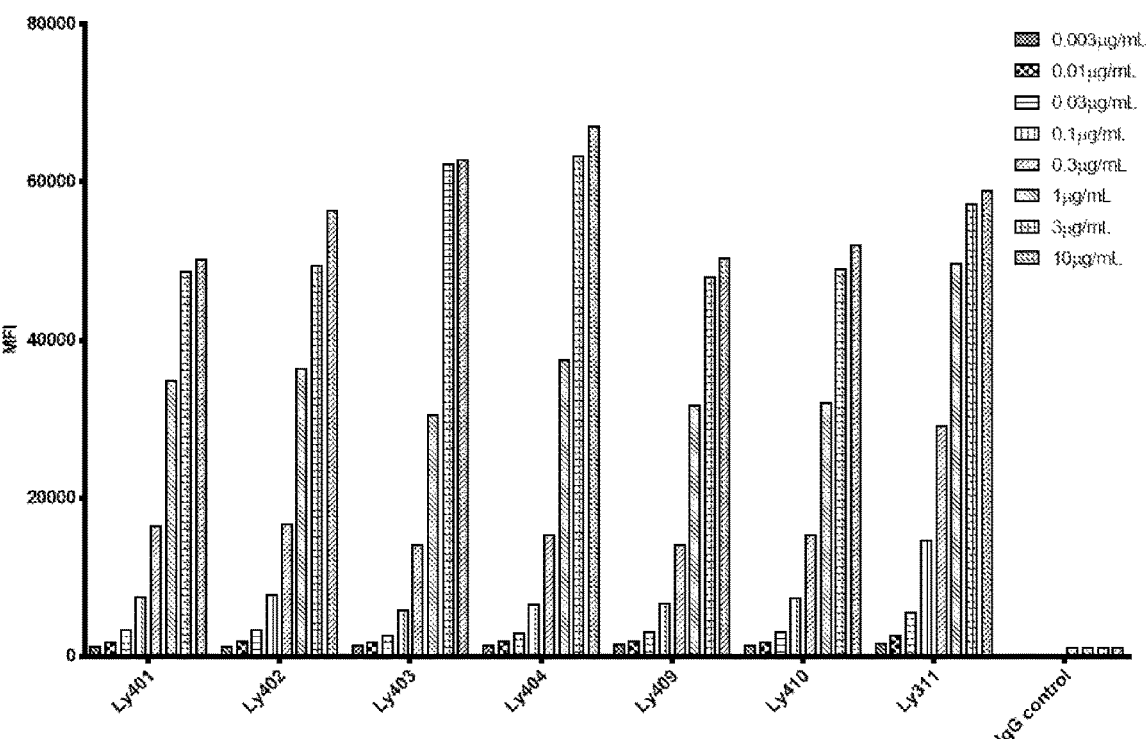
Figure 26E:
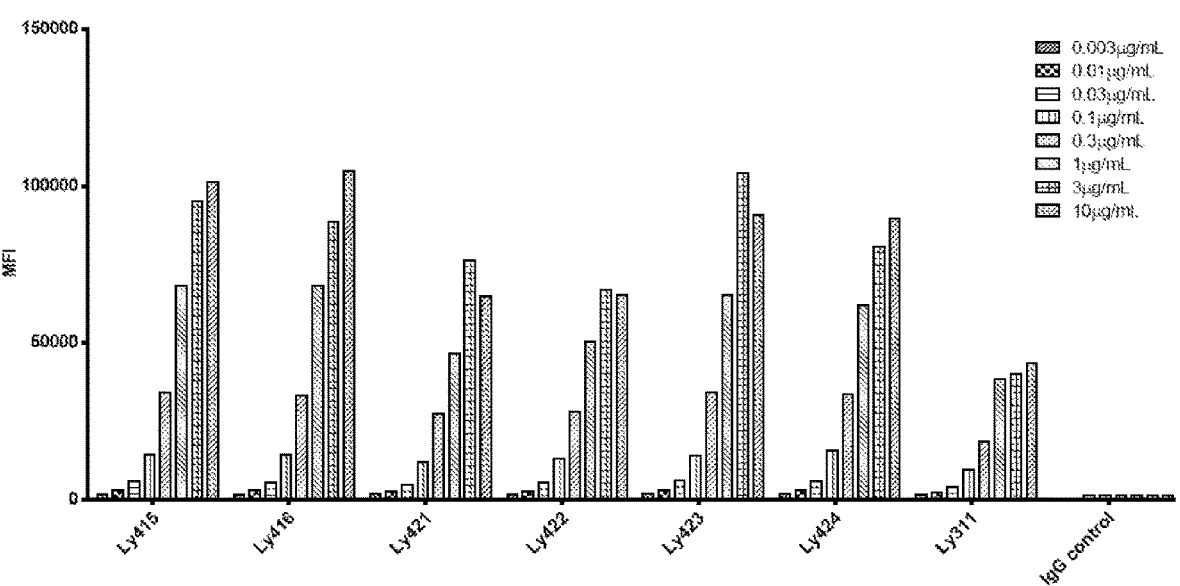
Figure 27A:
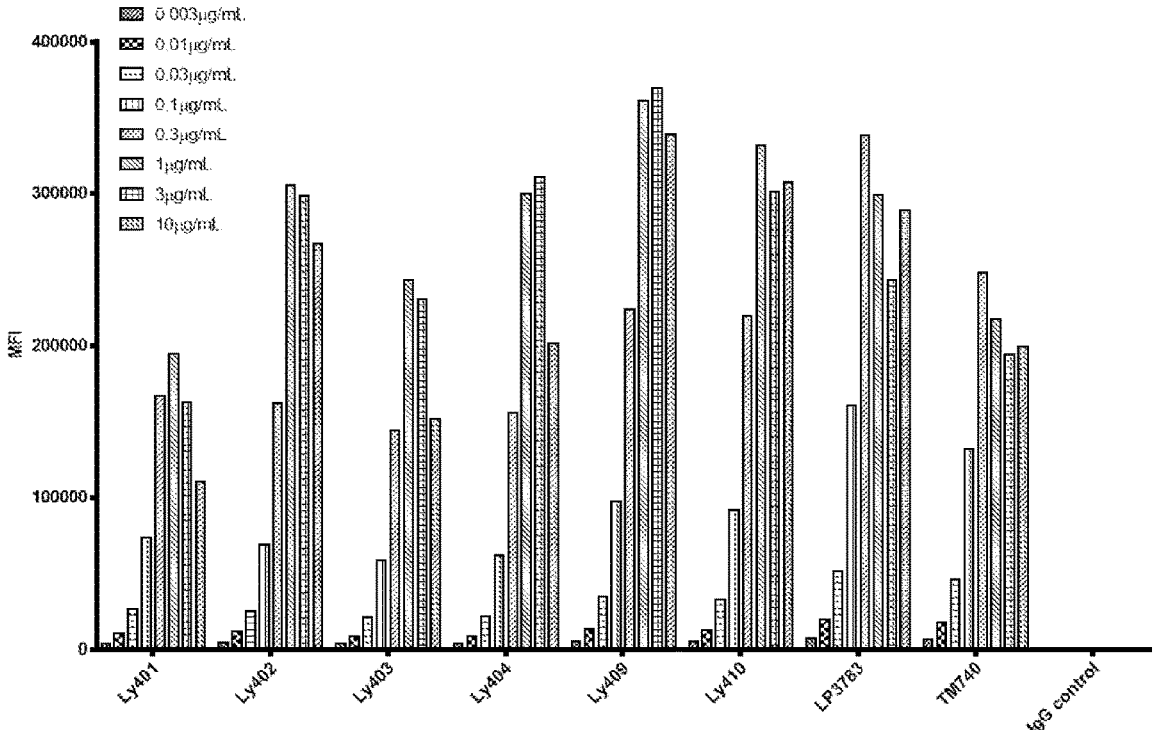
Figure 28B:
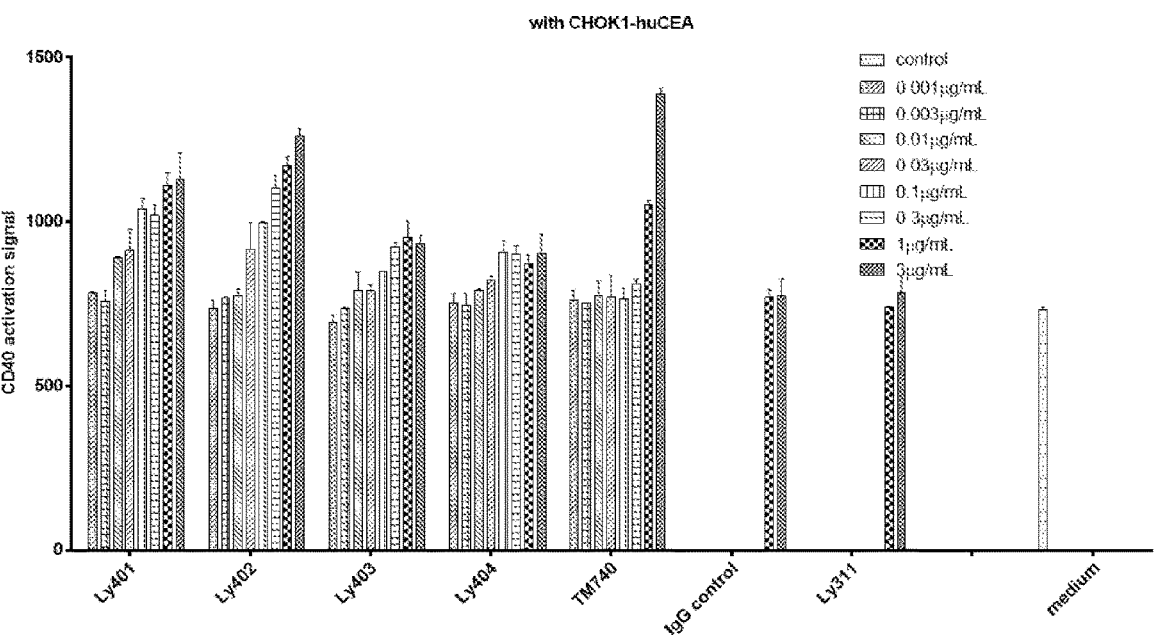
Figure 28C:
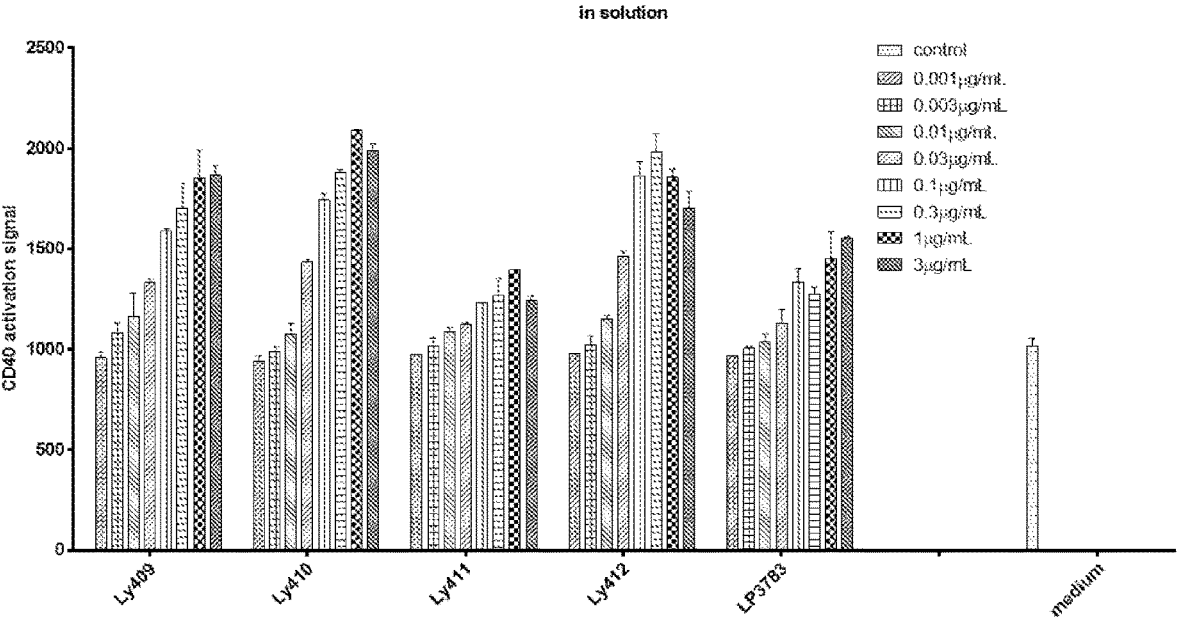
Figure 28D:
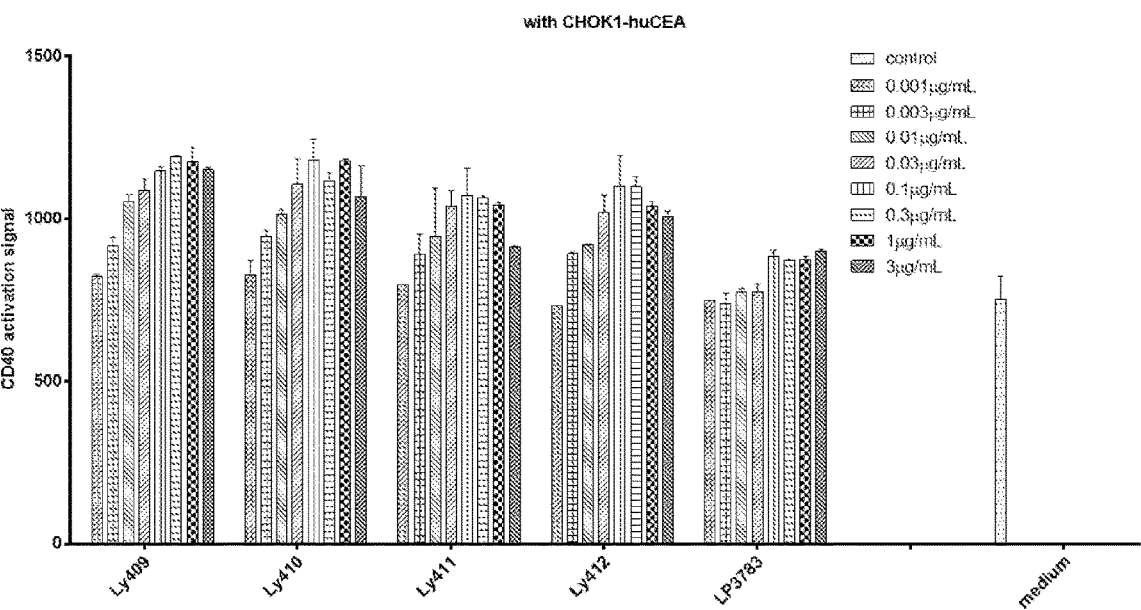
Figure 28E:
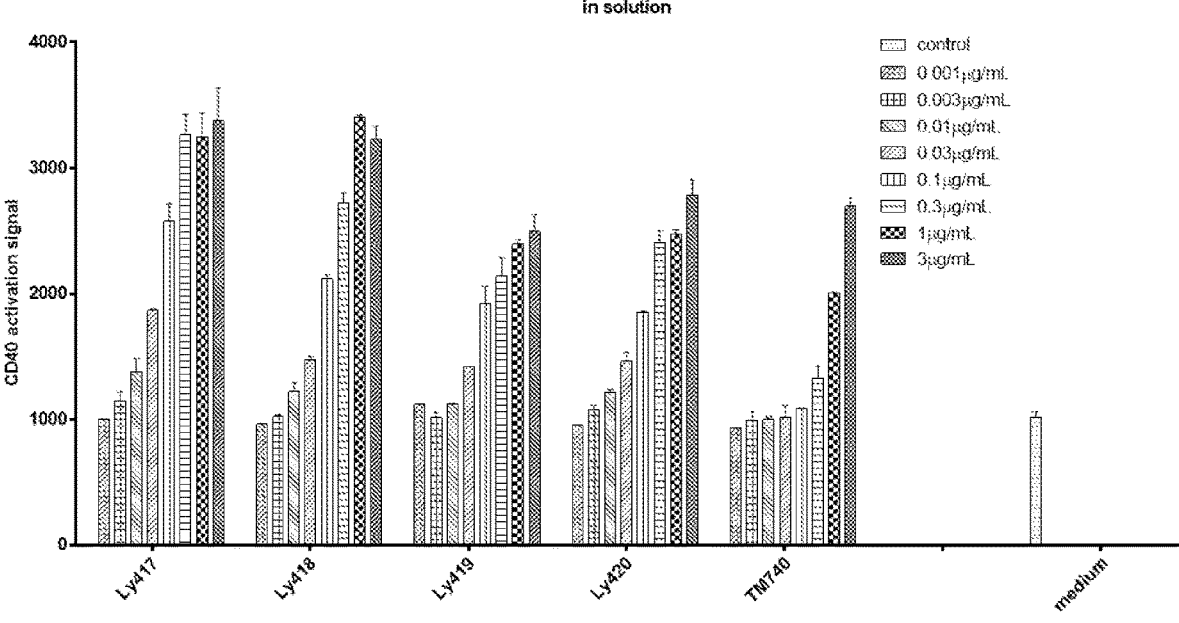
Figure 28F:
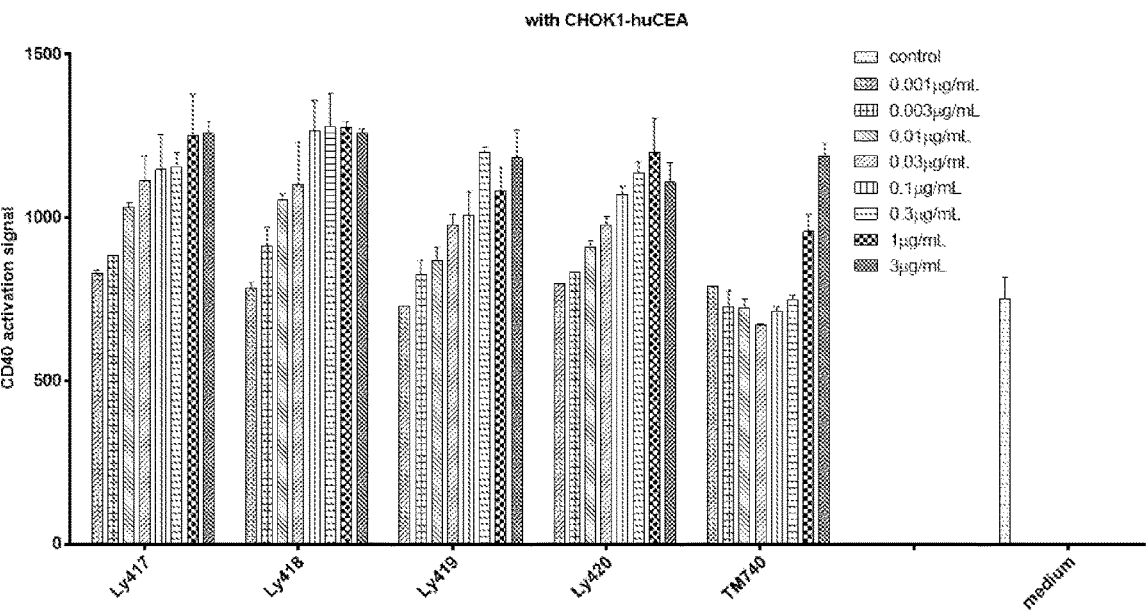
Figure 28G:
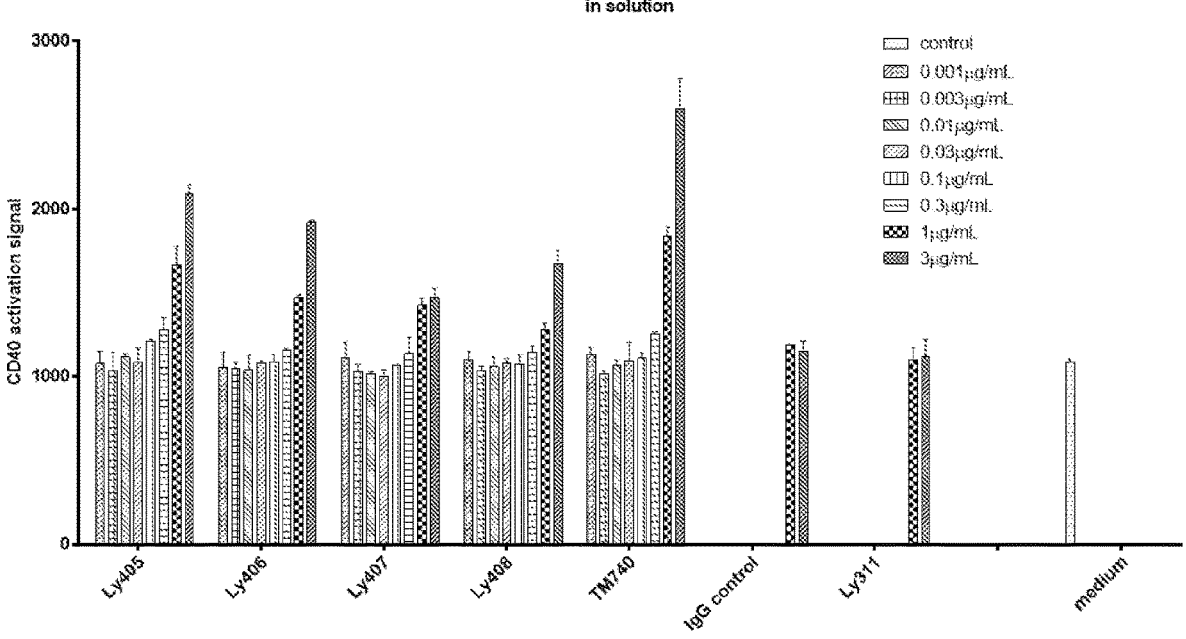
Figure 28H:
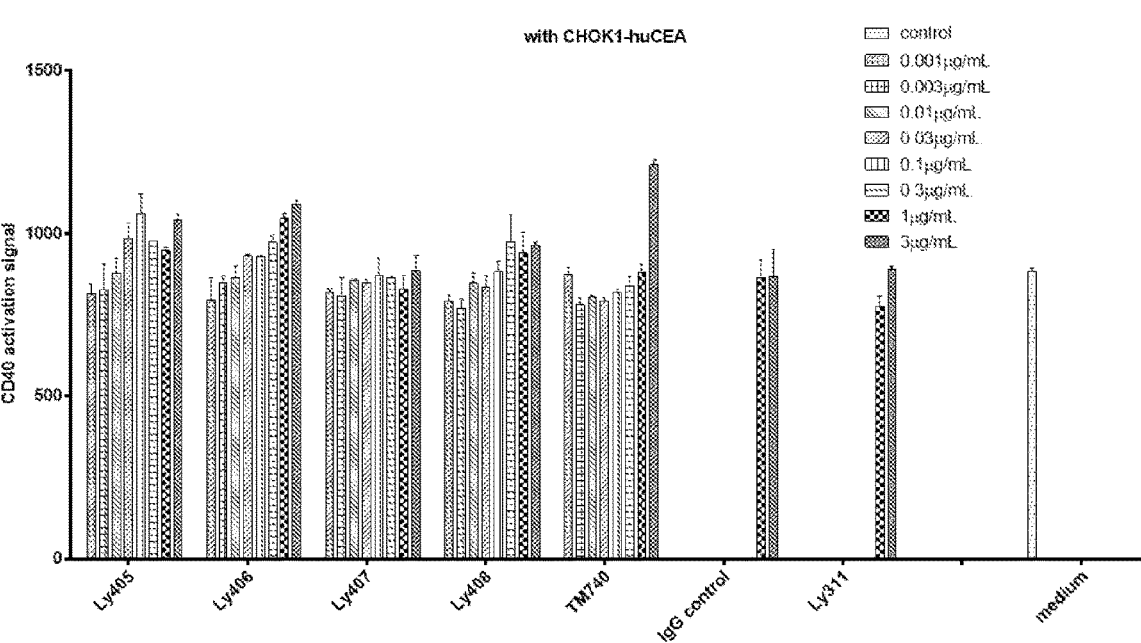
Figure 28I:
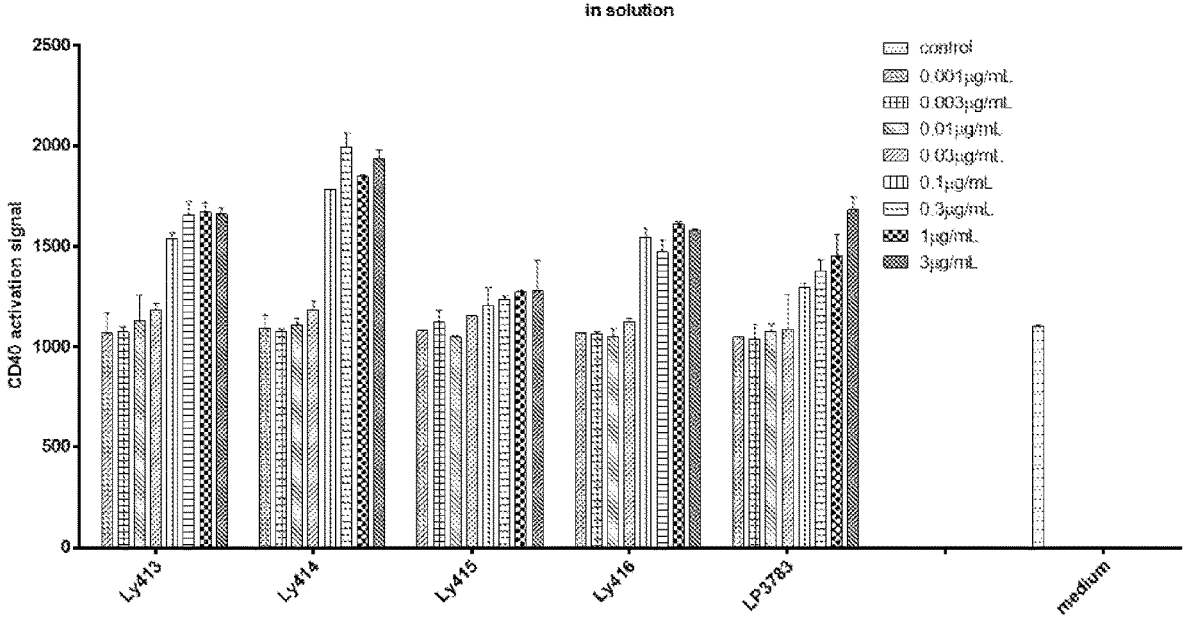
Figure 28J:
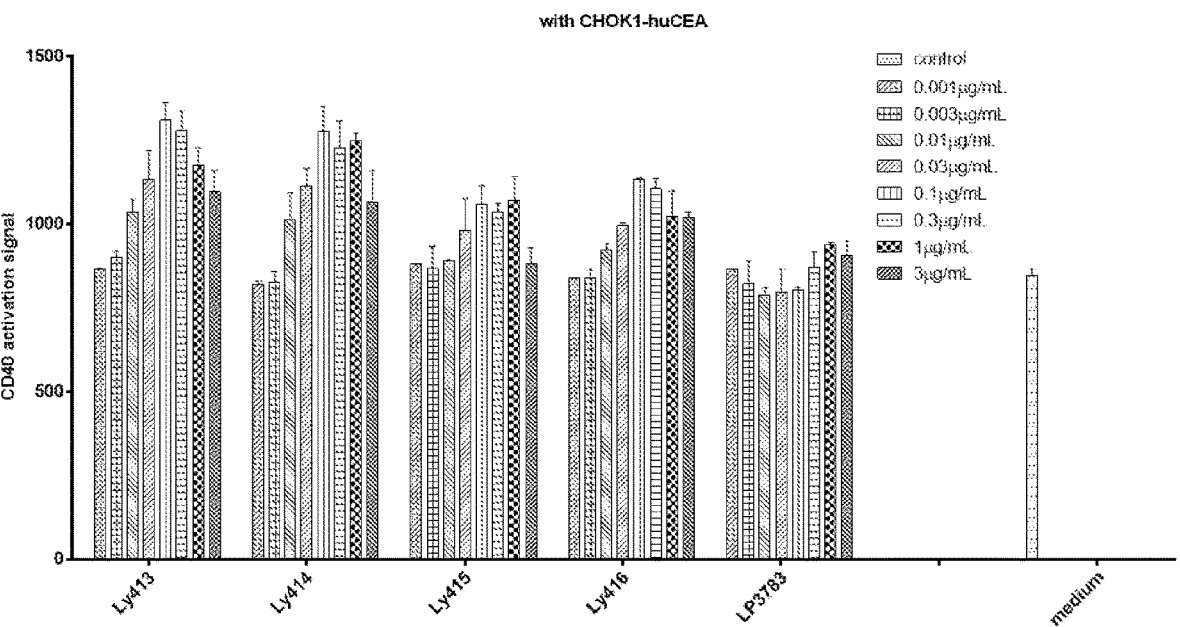
Figure 28K:
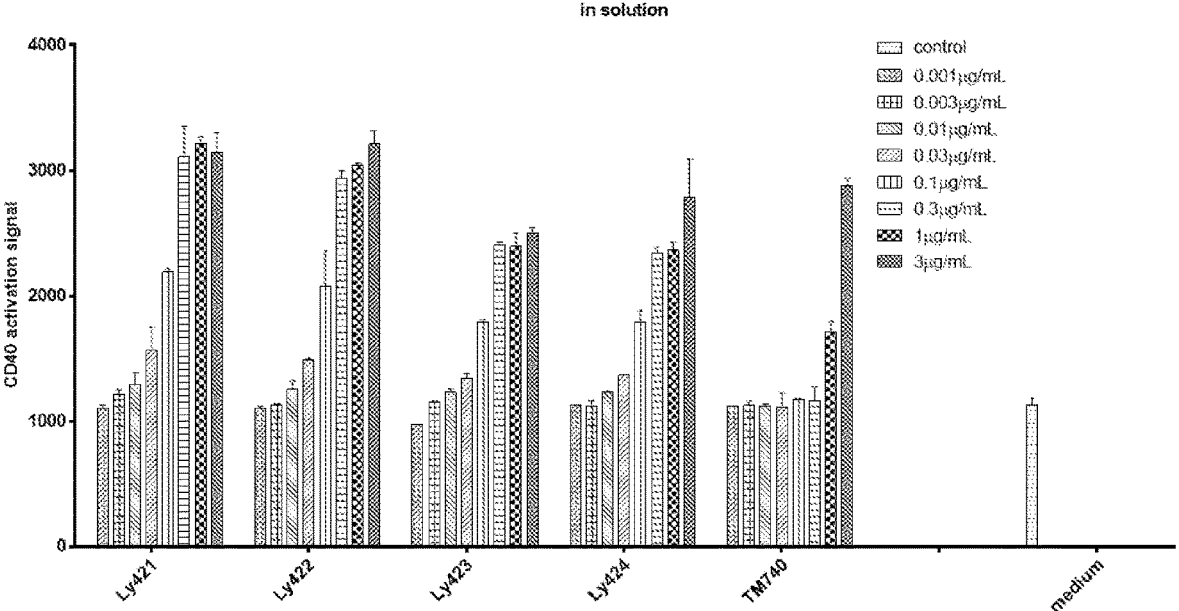
Figure 28L:
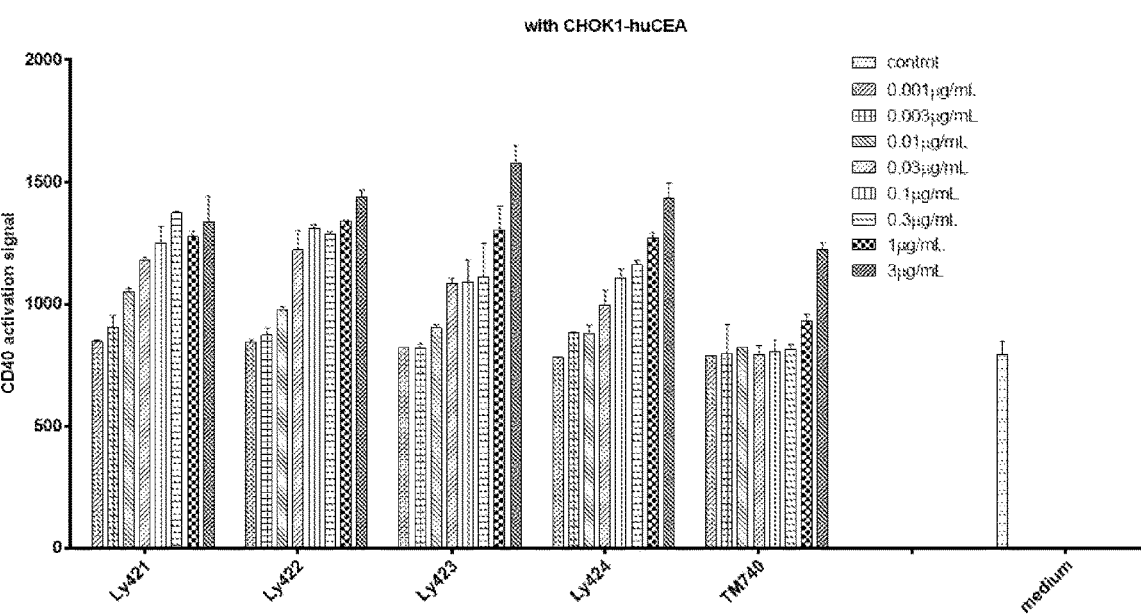

FIGS. 23A-23D are charts showing the activity of a number of anti-B7H4/CD40 antibodies on the proliferation of human B cells from two healthy donors, donor1 (FIGS. 23A and 23B) and donor2 (FIGS. 23C and 23D). The various antibodies are indicated on the x-axis, and the proliferation of human B cells are indicated by the signal of luminescence (RLU) on the y-axis.

FIGS. 24A-24H include a set of bar graphs showing the activity of exemplary anti-B7H4/CD40 antibodies in activation of human dendritic cells (DC) from two healthy donors by the antibodies either in solution (FIGS. 24A, 24C, 24E and 24G) or in co-culture of CHO cells expressing human B7H4 (FIGS. 24B, 24D, 24F and 24H). DC activation is indicated by the bar graphs signal of IL-8 in the culture supernatant.

FIGS. 25A-25I include a set of graphs showings pharmacokinetics of anti-B7H4/CD40 bispecific antibodies as indicated in mice. Clones Ly479 (25A), Ly483 (25B), Ly482 (25C), Ly478 (25D), Ly491 (25E), Ly490 (25F), Ly495 (25G), Ly475 (25H) and Ly494 (25I).

FIGS. 26A-26E are charts showing CEA binding activity of anti-CEA/CD40 antibodies as indicated on the x-axis to human CEA expressed on CHO cells. The bars ("IgG control") served as controls. Binding of these anti-CEA/CD40 antibodies are indicated by the mean fluorescence intensity (MFI) on the y-axis. 26A: Clones Ly401, Ly405, Ly410, Ly414, Ly417, Ly421, Ly311 and Ly312 at various concentrations as indicated. 26B: Clones Ly401-Ly404, Ly409, Ly410 and Ly311 at various concentrations. 26C: Clones Ly411, Ly412, Ly417-Ly420 and Ly311 at various concentrations as indicated. 26D: Clones Ly405-Ly408, Ly413, Ly414 ad Ly311 at various concentrations as indicated. 26E: Clones Ly415, Ly416, Ly421-Ly424 and Ly311 at various concentrations.

FIGS. 27A-27D are charts showing CD40 binding activity of anti-CEA/CD40 antibodies as indicated on the x-axis to human CD40 expressed on CHO cells. The bars ("IgG control") served as controls. Binding of these anti-CEA/CD40 antibodies are indicated by the mean fluorescence intensity (MFI) on the y-axis. 27A: Clones Ly401-Ly404, Ly409, Ly410, LP3783 and TM740 at various concentrations as indicated. 27B: Clones Ly411, Ly412, Ly417-Ly420, TM740 and LP3783 at various concentrations as indicated. 27C: Ly405-Ly408, Ly413, Ly414, LP3783 and TM740 at various concentrations as indicated. 27D: Ly415, Ly416, Ly421-Ly424, TM740 and LP3783 at various concentrations as indicated.

FIGS. 28A-28L are charts showing stimulation of human CD40 activation as indicated by IL8 secretion in a reporter assay by a number of anti-CEA/CD40 antibodies. The agonistic activity of these bispecific antibodies was evaluated either in solution, or co-cultured with CEA overexpressing CHO cells. The various antibodies are indicated on the x-axis, and the CD40 activation signal are indicated on the y-axis. FIGS. 28A, 28C, 28E, 28G, 28I, and 28K: activating of CD40 by the clones in solution as indicated at various concentrations as also indicated. FIGS. 28B, 28D, 28F, 28H, 28J, and 28L: activating of CD40 by the clones as indicated when cocultured with CEA overexpressing CHO cells at various concentrations as also indicated.

Figure 29A:
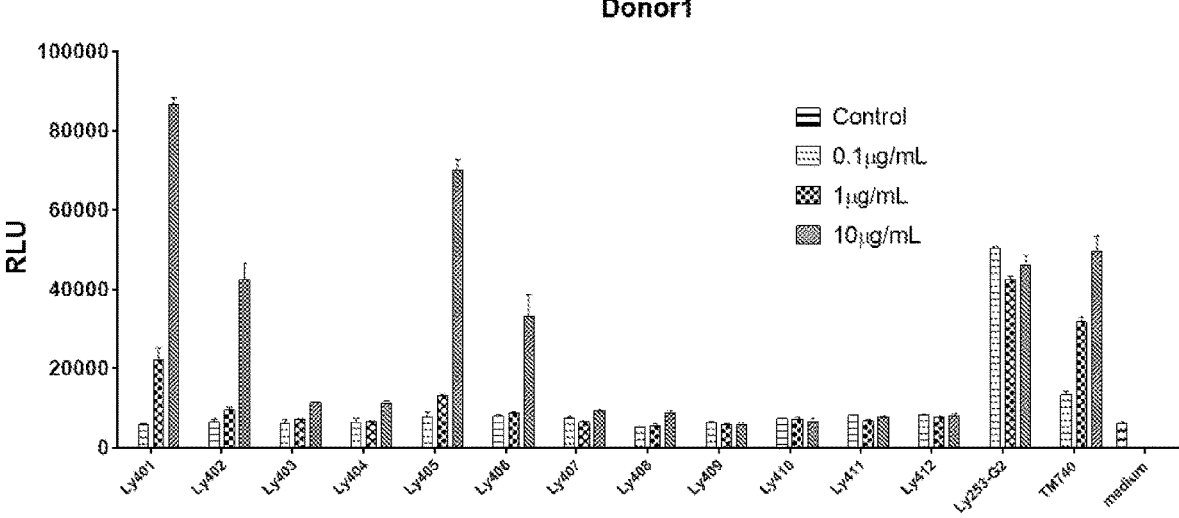
Figure 29B:
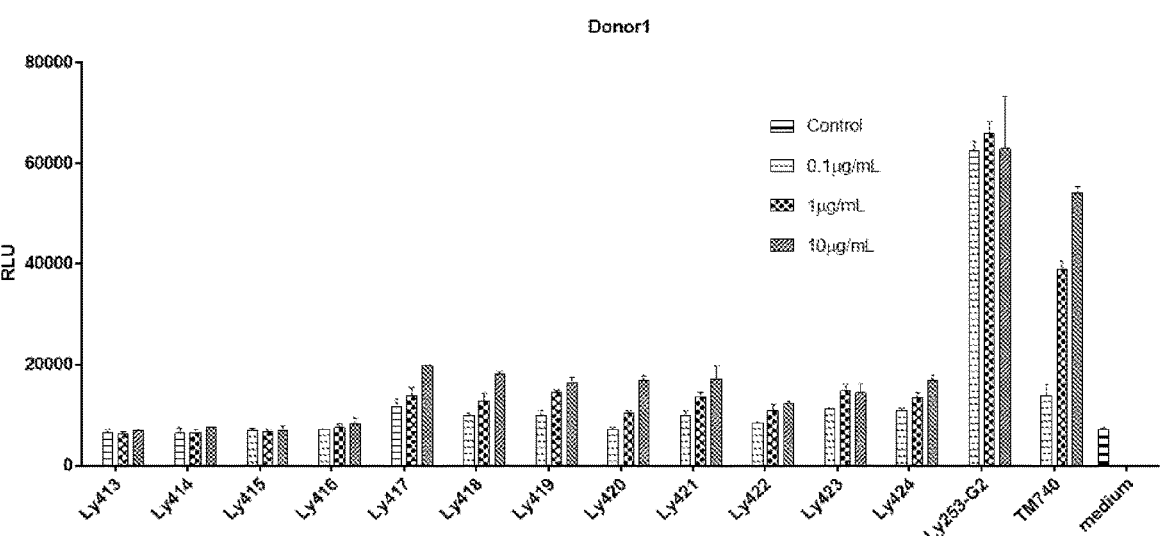
Figure 29C:
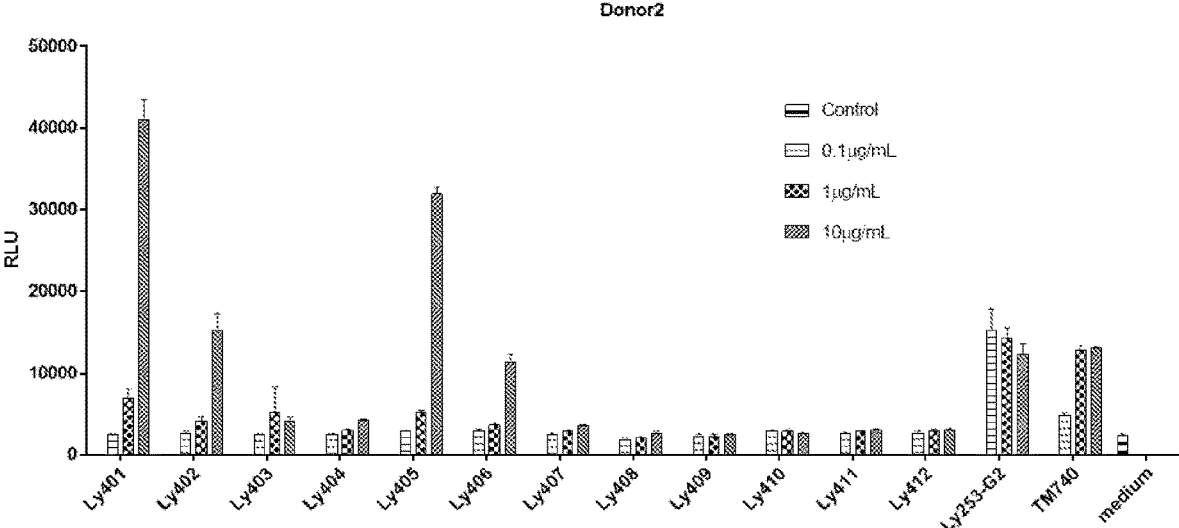
Figure 29D:
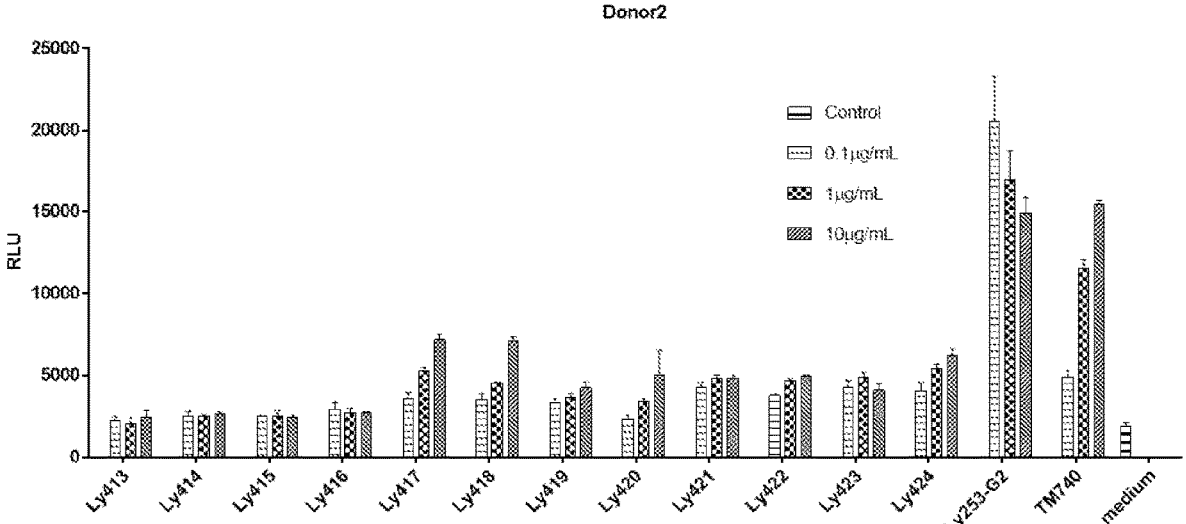

FIGS. 29A-29D are charts showing the activity of a number of anti-CEA/CD40 antibodies on the proliferation of human B cells from two healthy donors, donor1 (FIGS. 29A and 29B) and donor2 (FIGS. 29C and 29D). The various antibodies are indicated on the x-axis, and the proliferation of human B cells are indicated by the signal of luminescence (RLU) on the y-axis.

Figures 30A, 30B:
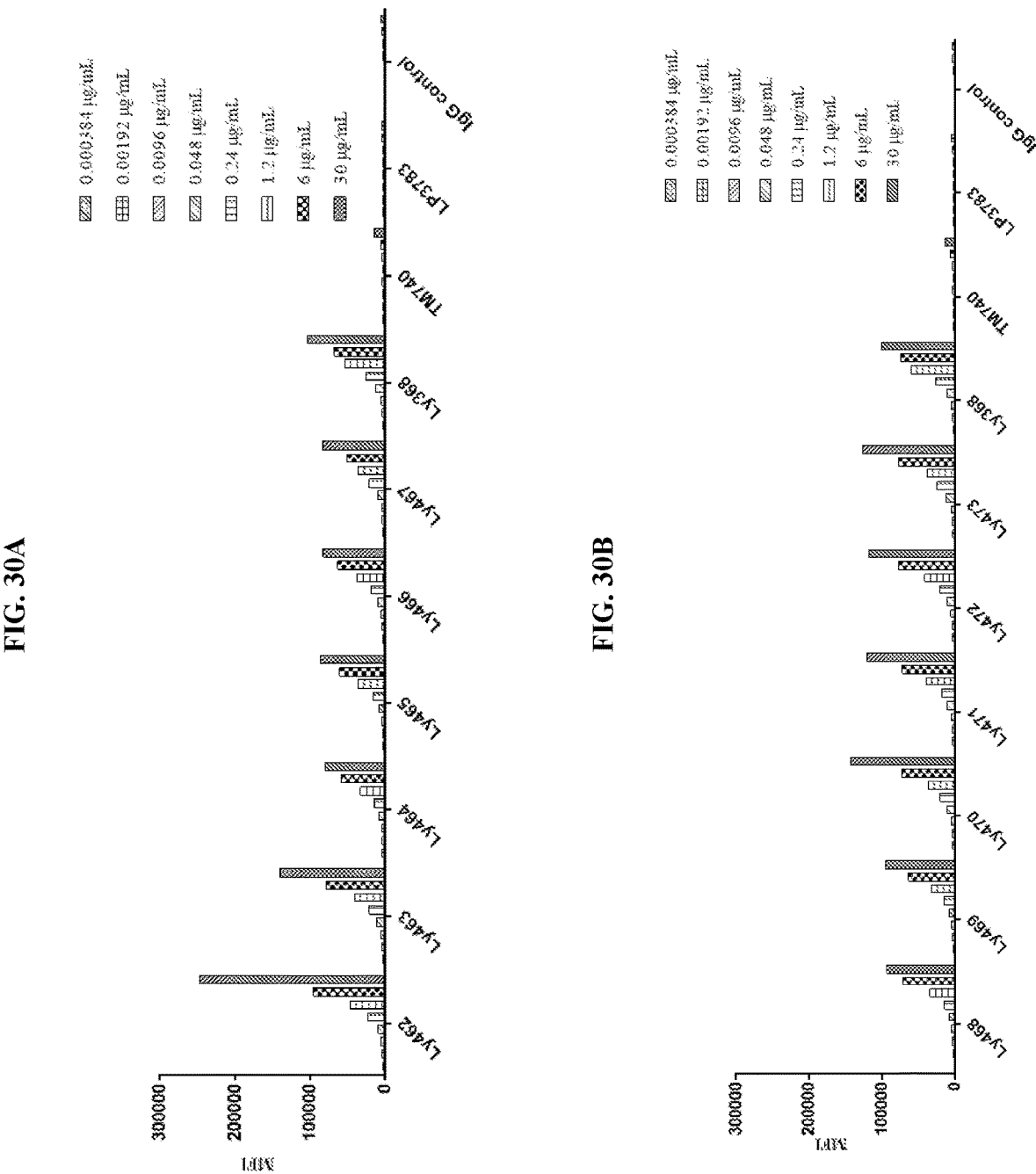

FIGS. 30A-30B are charts showing binding activity of anti-TNT/CD40 antibodies as indicated on the x-axis to necrotic MC38 cells. The bars ("IgG control") served as controls. Binding of these anti-TNT/CD40 antibodies are indicated by the mean fluorescence intensity (MFI) on the y-axis. 30A: Clones Ly462-Ly467, Ly368, TM740 and LP3783 at various concentrations as indicated. 30B: Clones Ly468-Ly473, Ly368, TM740 and LP3783 at various concentrations as indicated.

FIGS. 31A-31B are charts showing CD40 binding activity of anti-TNT/CD40 antibodies as indicated on the x-axis to human CD40 expressed on CHO cells. The bars ("IgG control") served as controls. Binding of these anti-TNT/CD40 antibodies are indicated by the mean fluorescence intensity (MFI) on the y-axis. 31A: Clones Ly462-Ly467, Ly368, TM740 and LP3783 at various concentrations as indicated. 31B: Clones Ly468-Ly473, Ly368, TM740 and LP3783 at various concentrations as indicated.

Figure 32A:
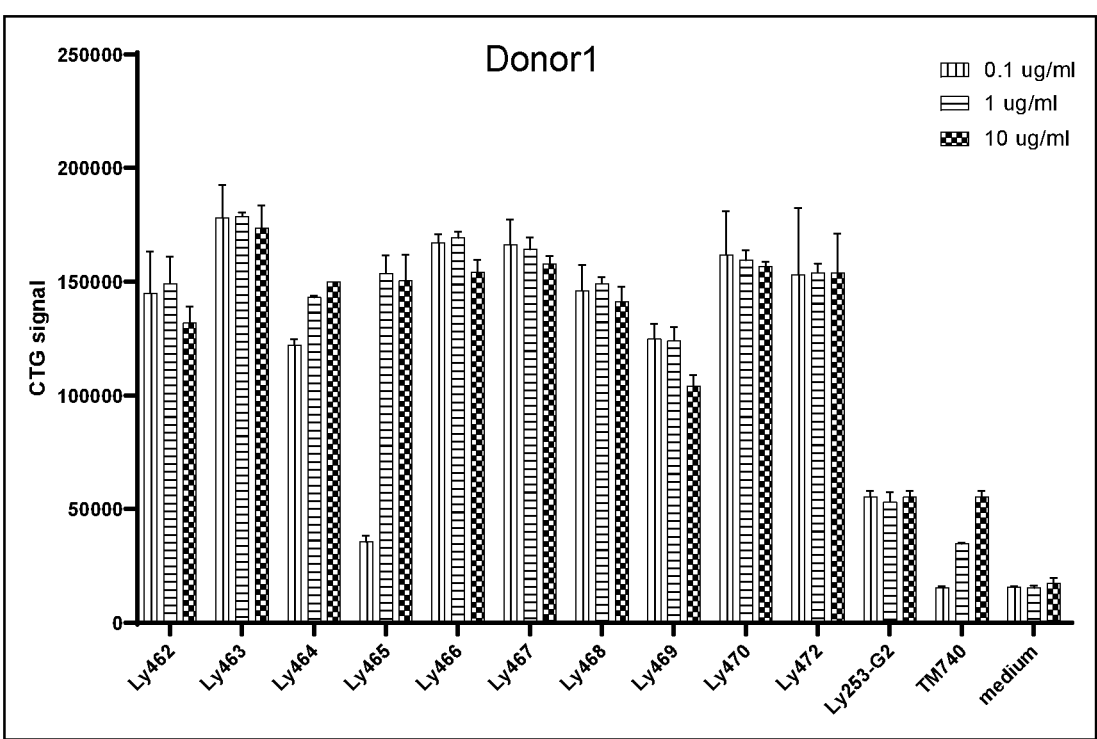
Figure 32B:
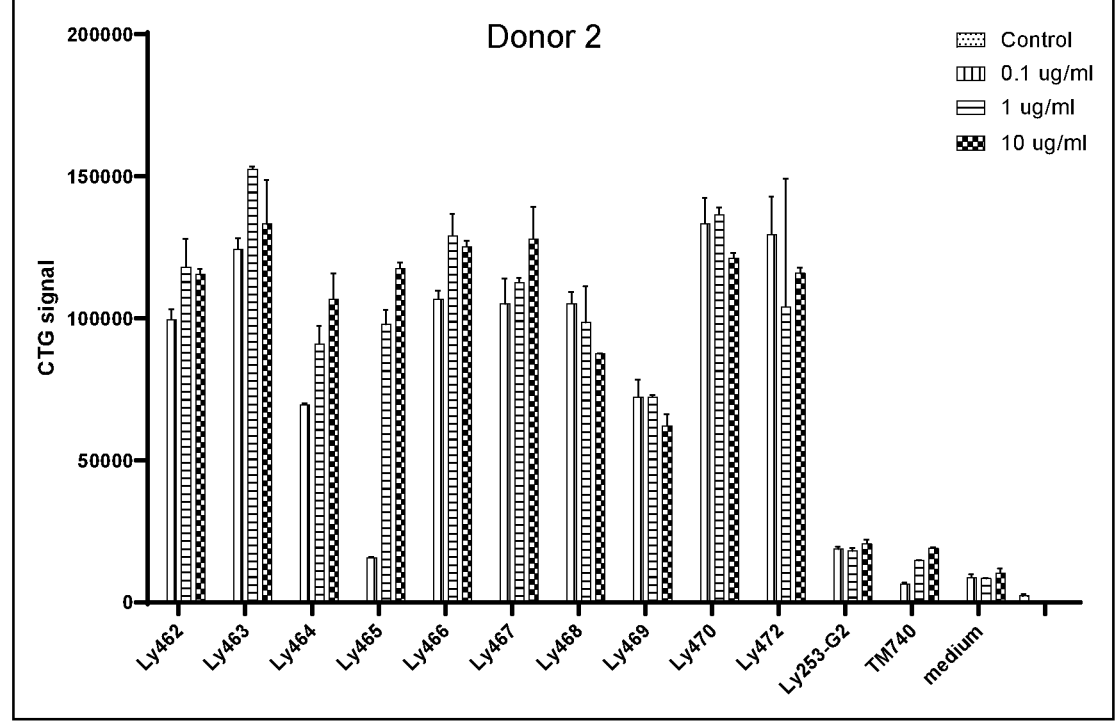

FIGS. 32A-32B are charts showing the activity of a number of anti-TNT/CD40 bispecific antibodies on the proliferation of human B cells from two healthy donors. The various antibodies are indicated on the x-axis, and the proliferation of human B cells are indicated by the signal of luminescence (RLU) on the y-axis. 32A: Donor 1. 32B: Donor 2.

Figure 33A:
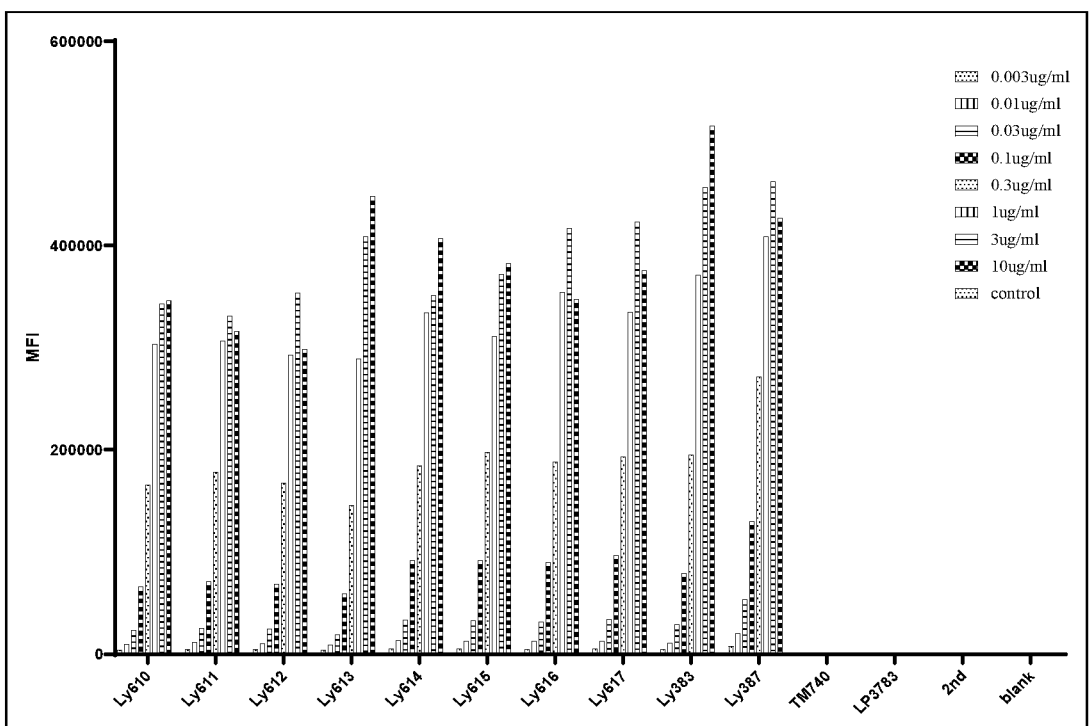
Figure 33B:
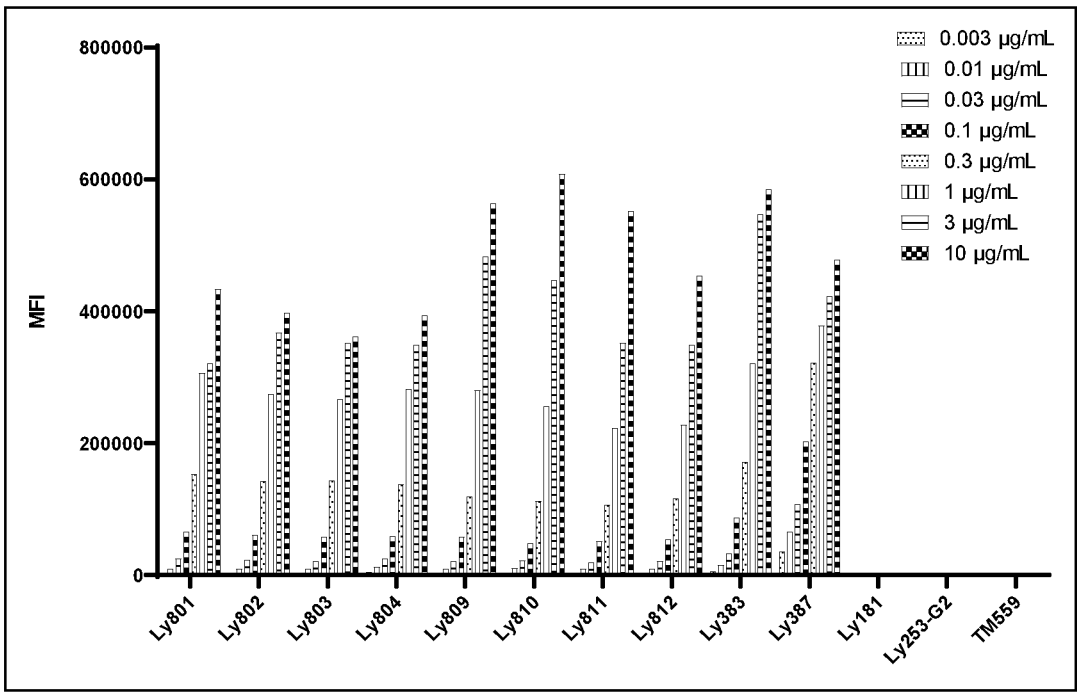
Figure 33C:
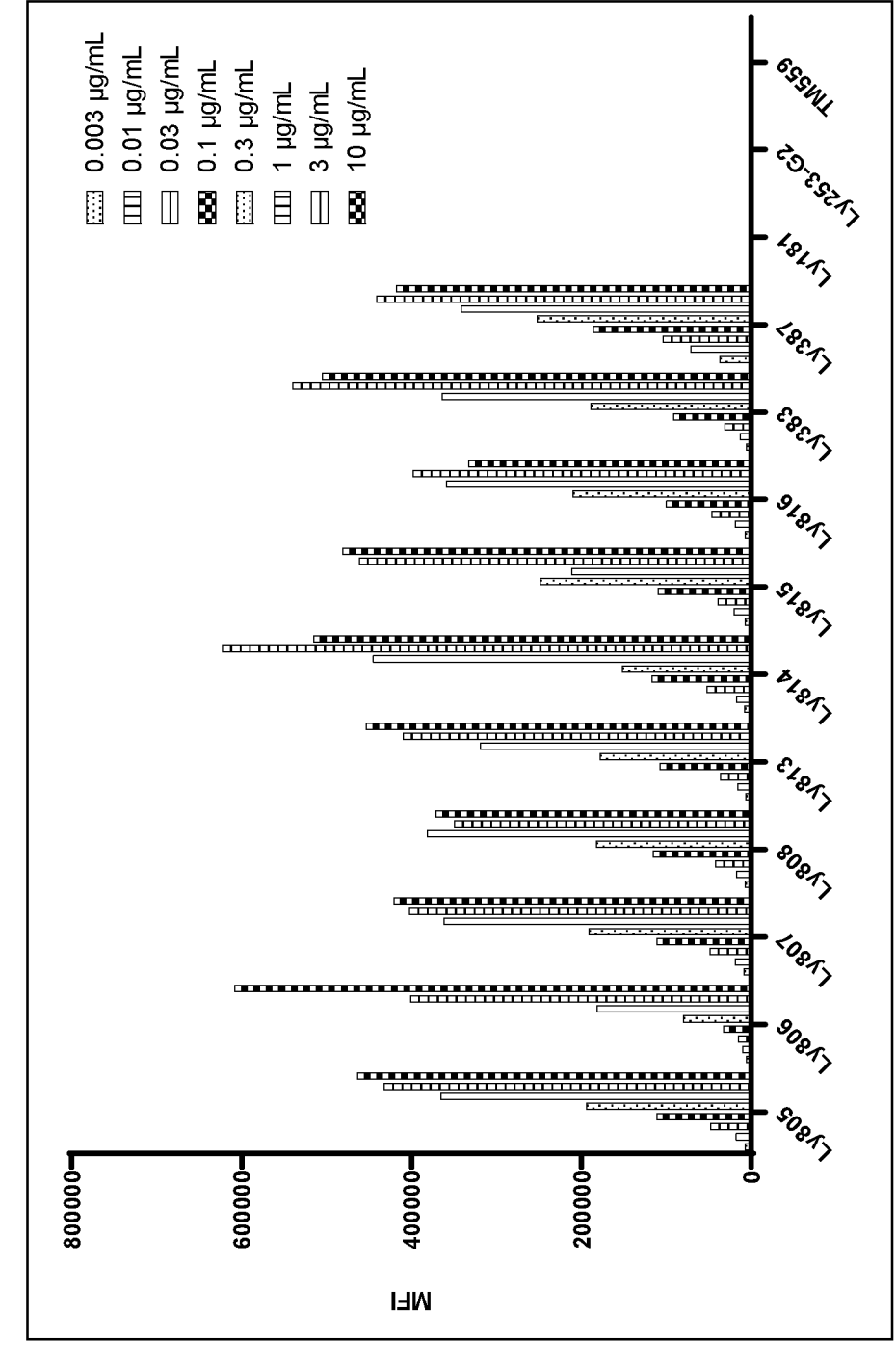

FIGS. 33A-33C are charts showing B7H3 binding activity of anti-B7H3/CD40 bispecific antibodies as indicated on the x-axis to human B7H3 expressed on CHO cells. The bars labeled "IgG control" served as controls. Binding of these anti-B7H3/CD40 bispecific antibodies are indicated by the mean fluorescence intensity (MFI) on the y-axis. 33A: Clones Ly610, Ly611, Ly612, Ly613, Ly614, Ly615, Ly616, Ly617, Ly383, Ly076, TM740 and Ly3783 at various concentrations as indicated. 33B: Clones Ly801, Ly802, Ly803, Ly804, Ly809, Ly810, Ly811, Ly812, Ly383, Ly387, Ly181, Ly253-G2 and TM559 at various concentrations as indicated. 33C: Clones Ly805, Ly806, Ly807, Ly808, Ly813, Ly814, Ly815, Ly816, Ly383, Ly387, Ly181, Ly253-G2 and TM559 at various concentrations as indicated.

Figure 34A:
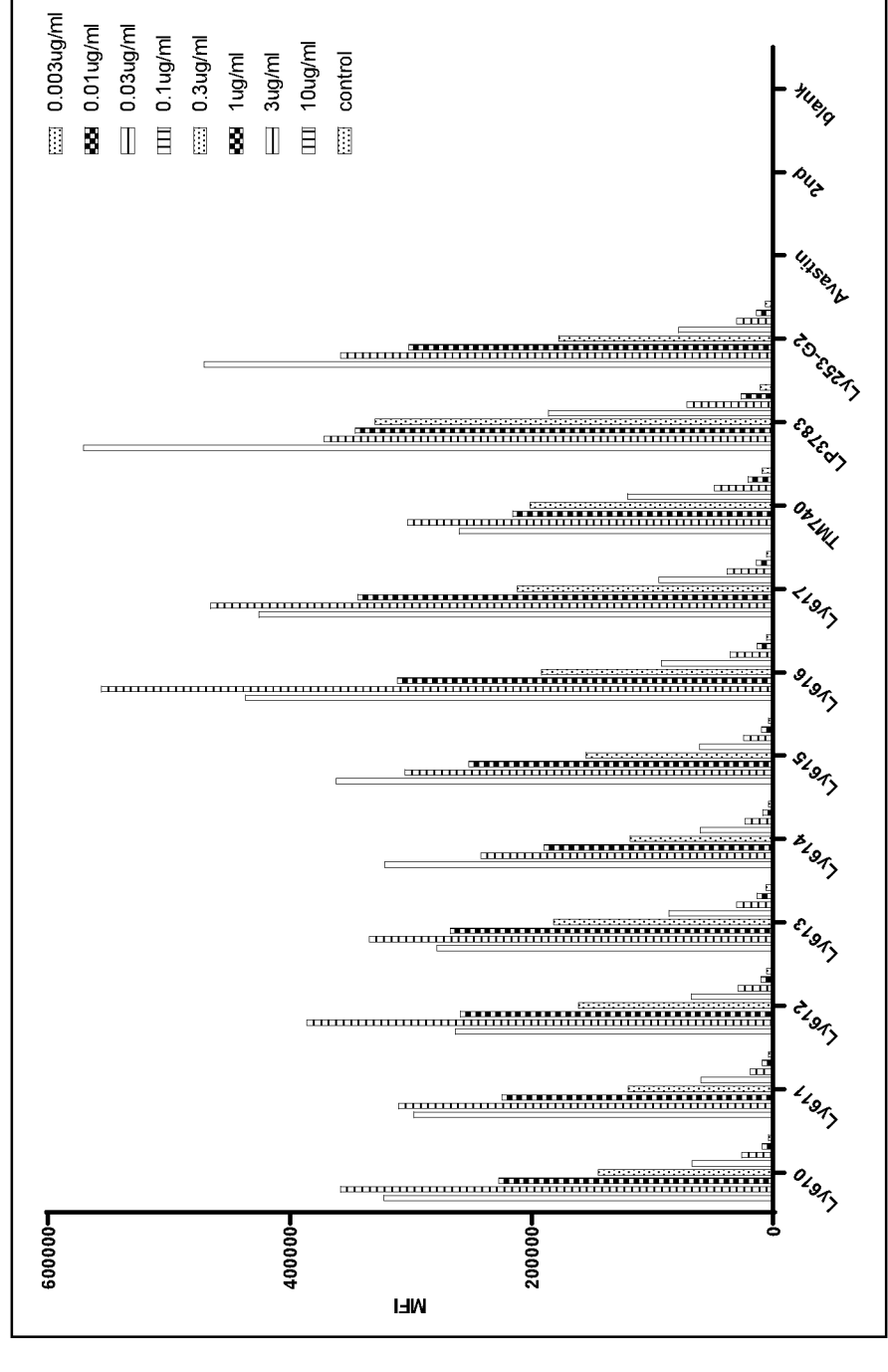
Figure 34B:
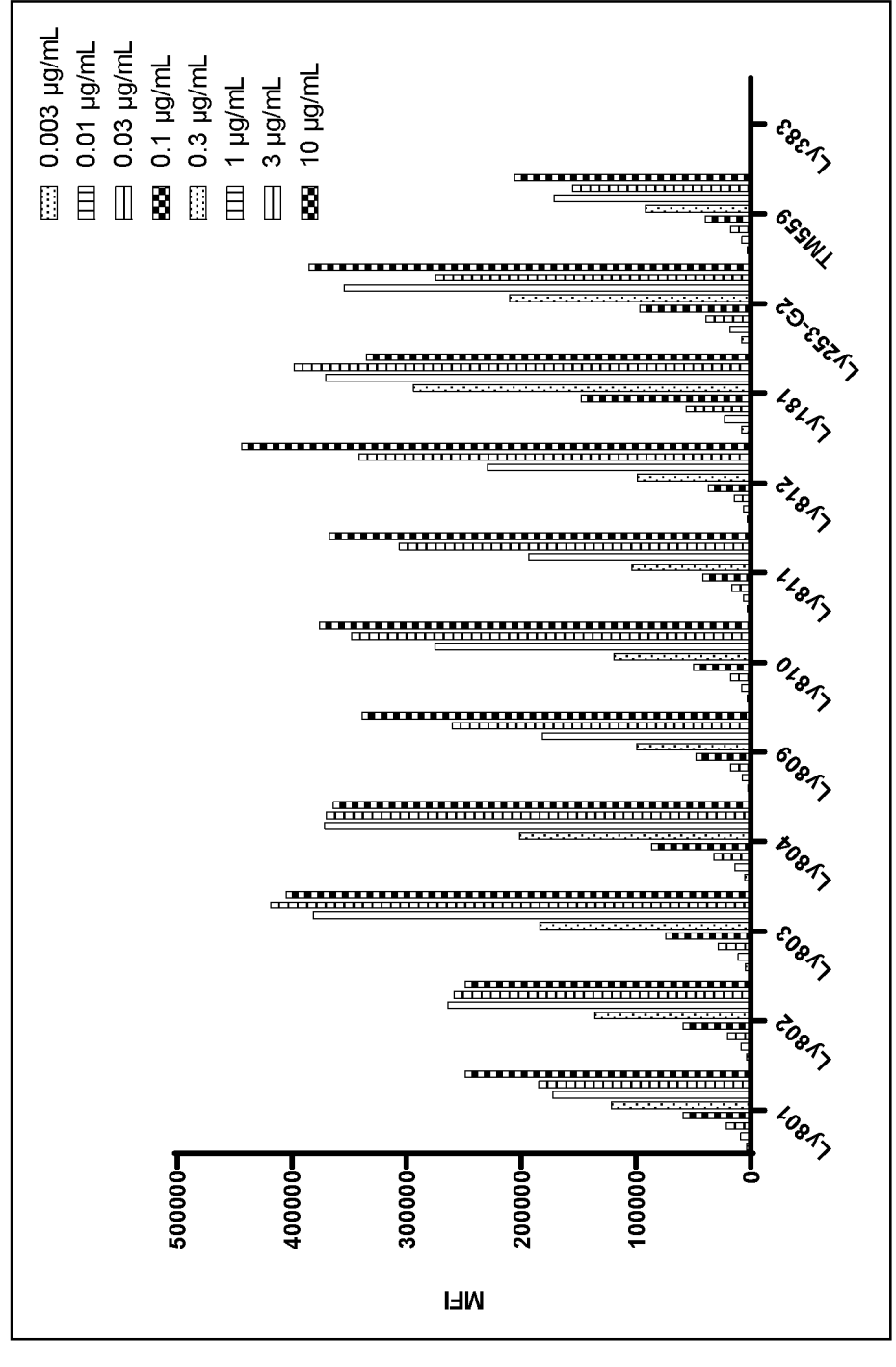
Figure 34C:
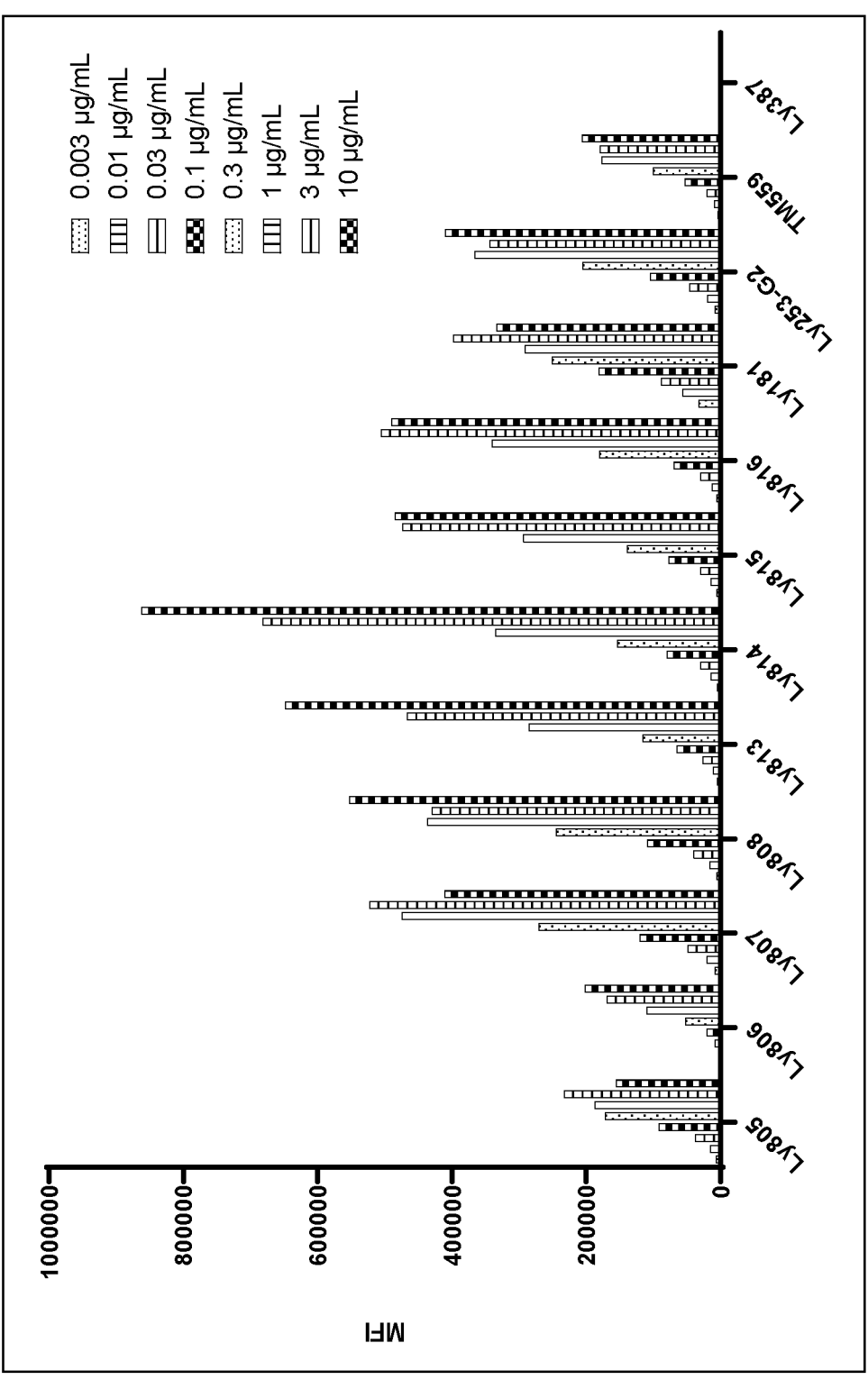

FIGS. 34A-34C are charts showing CD40 binding activity of anti-B7H3/CD40 bispecific antibodies as indicated on the x-axis to human CD40 expressed on CHO cells. Ly253-G2 was used as controls. Binding of these anti-B7H3/CD40 bispecific antibodies are indicated by the mean fluorescence intensity (MFI) on the y-axis. 34A: Clones Ly610, Ly611, Ly612, Ly613, Ly614, Ly615, Ly616, Ly617, TM740, Ly3783 and Ly253-G2 at various concentrations as indicated. 34B: Clones Ly805, Ly806, Ly807, Ly808, Ly813, Ly814, Ly815, Ly816, Ly181, TM383, TM559 and Ly387 at various concentrations as indicated. 34C: Clones Ly801, Ly802, Ly803, Ly804, Ly809, Ly810, Ly811, Ly812, Ly181, TM383, TM559 and Ly383 at various concentrations as indicated.

FIGS. 35A-35H are charts showing simultaneously binding of exemplary anti-B7H3/CD40 antibodies to recombinant human B7H3 and CD40 proteins. Clones Ly610 (35A), Ly611 (35B), Ly612 (35C), Ly613 (35D), Ly614 (35E), Ly615 (35F), Ly616 (35G) and Ly617 (35H) at various concentrations as indicated.

Figure 36:
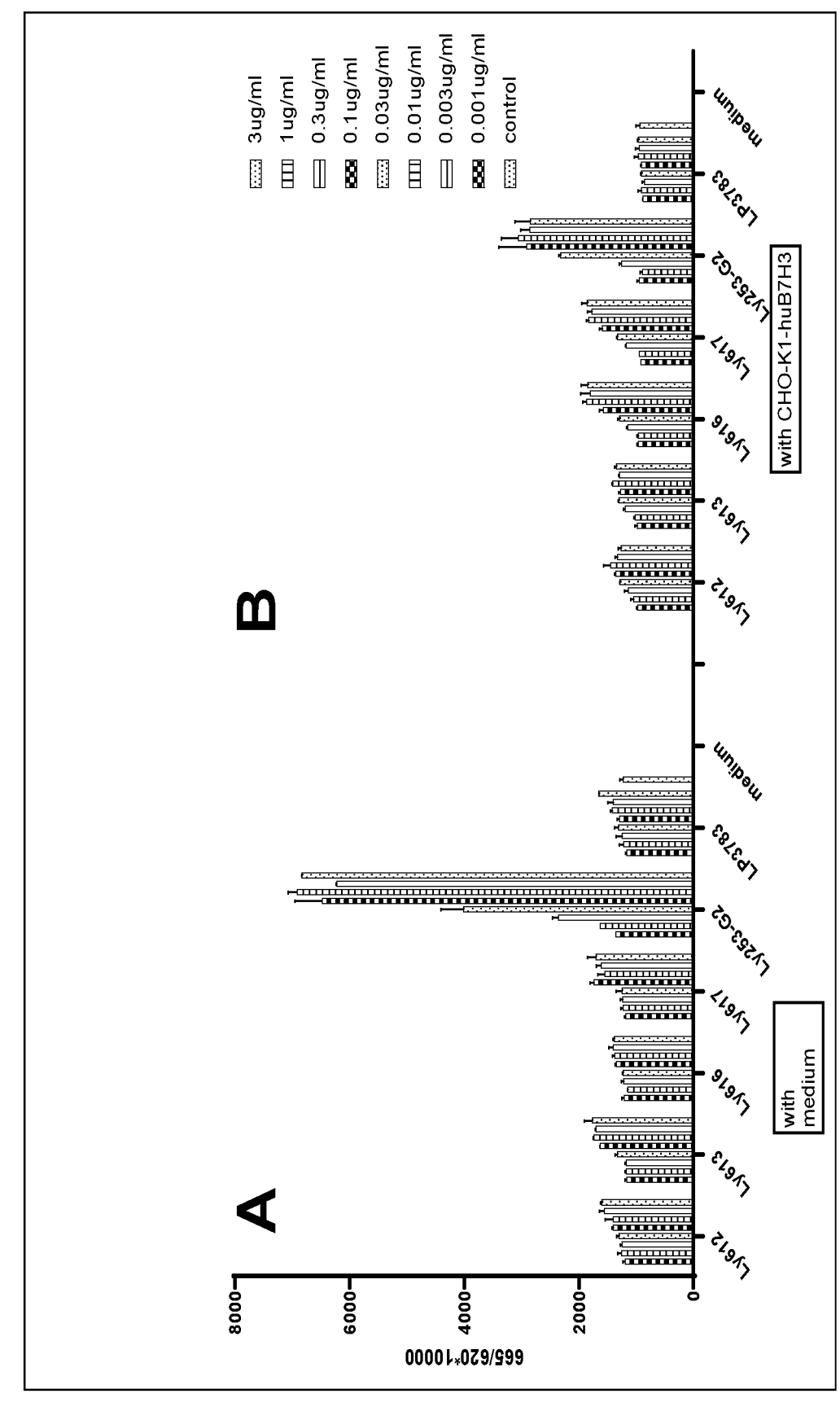
Figure 36:
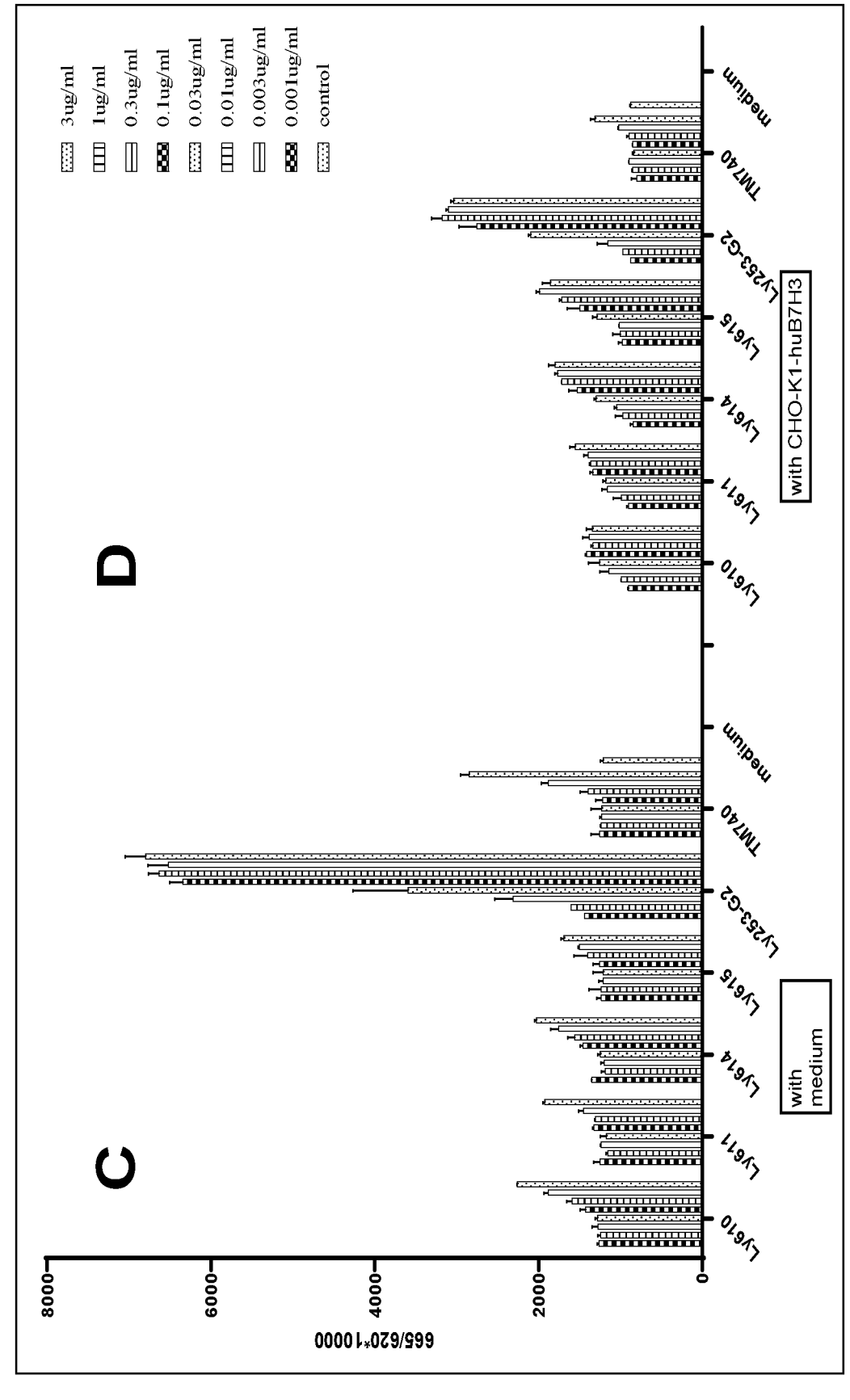
Figure 36:
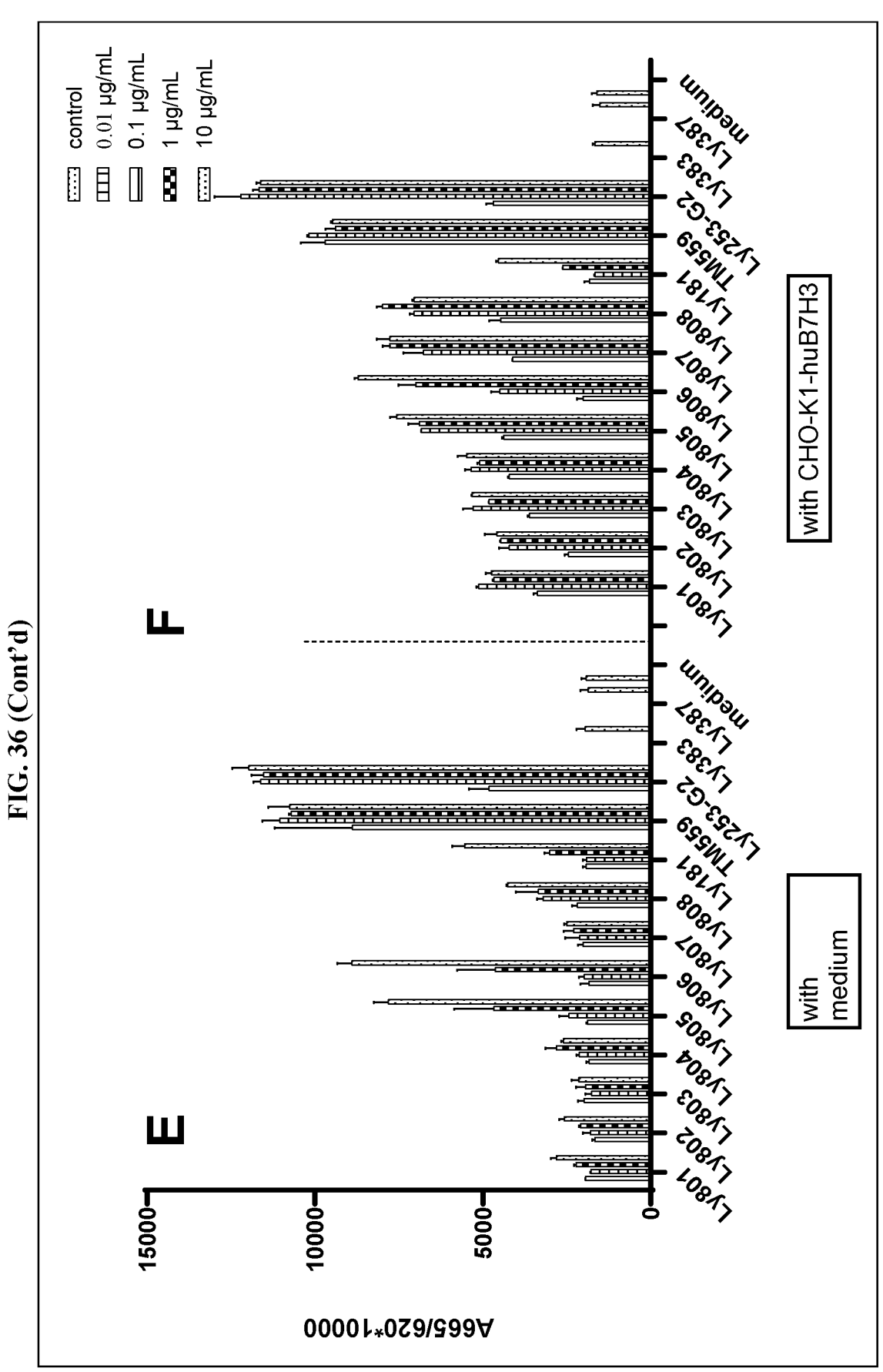
Figure 37A:
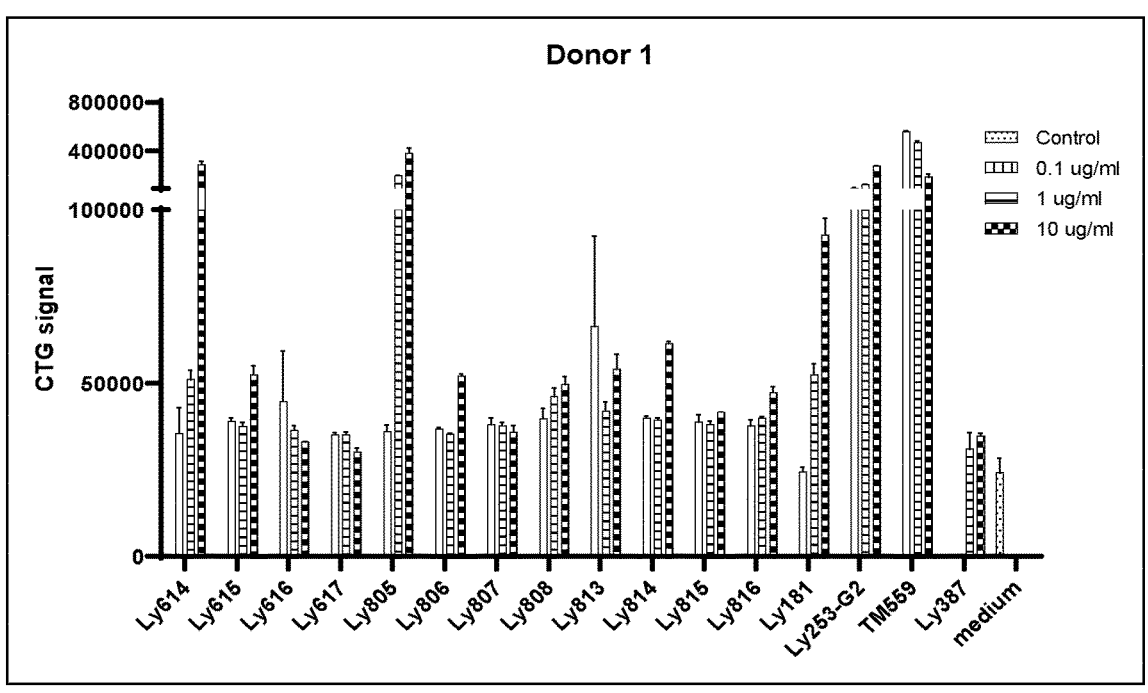
Figure 37B:
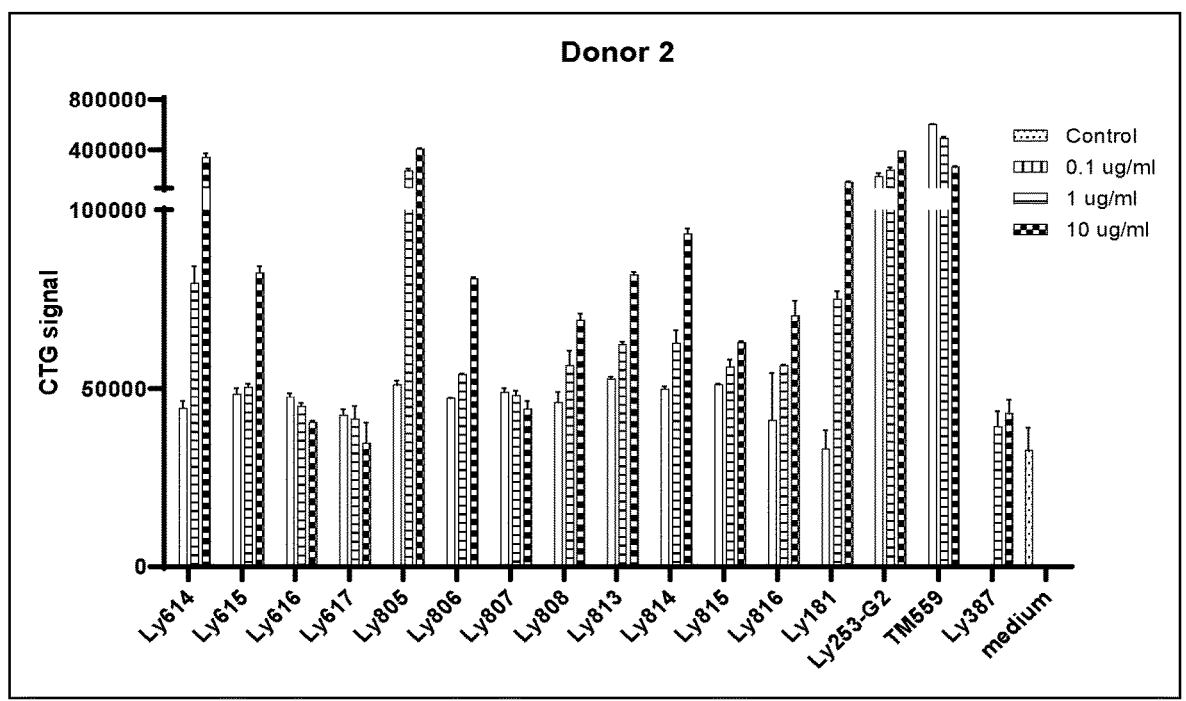
Figure 37C:
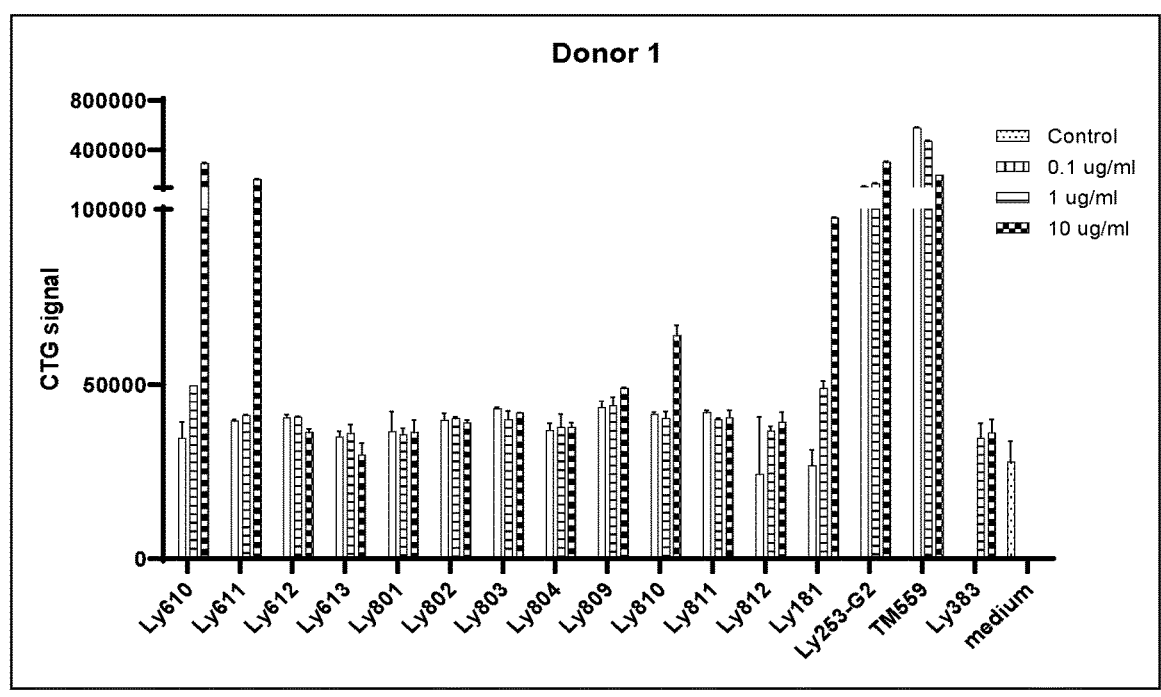
Figure 37D:
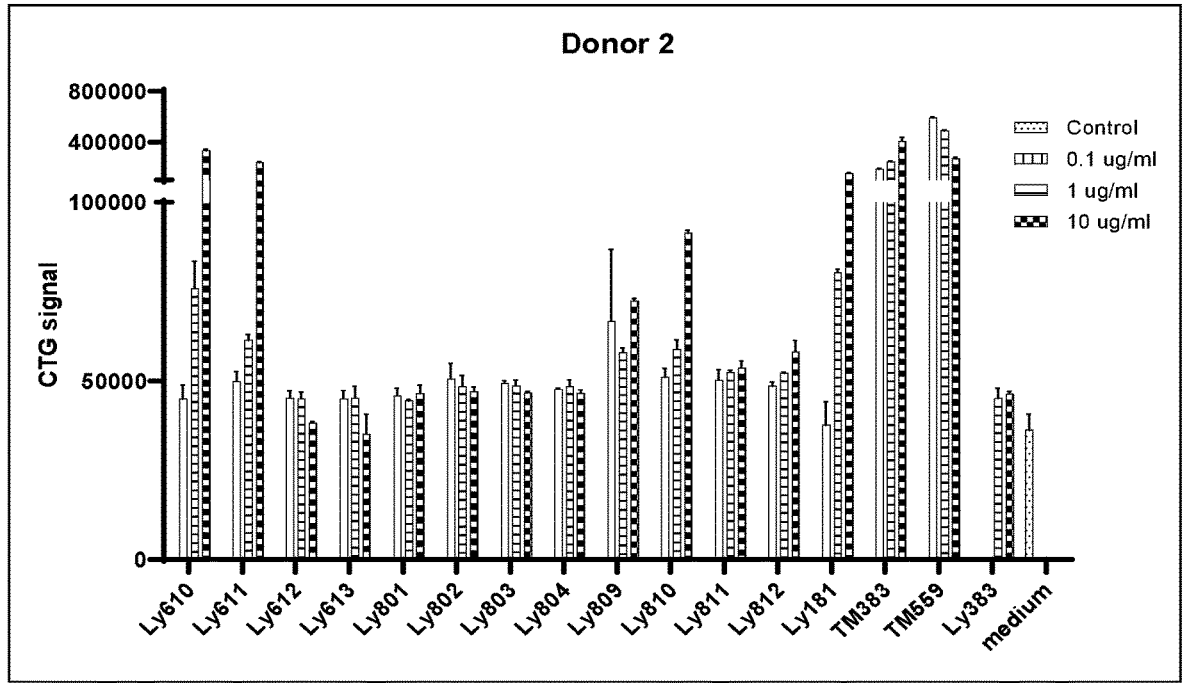

FIG. 36 includes charts showing stimulation of human CD40 activation as indicated by IL8 secretion in a reporter assay by a number of anti-B7H3/CD40 antibodies. The agonistic activity of these bispecific antibodies was evaluated either in solution, or co-cultured with B7H3 overexpressing CHO cells. The various antibodies are indicated on the x-axis, and the CD40 activation signal are indicated on the y-axis. The bars labeled as "IgG control" and "Mediun" served as controls. Panel A: Clones Ly612, Ly613, Ly616, Ly617, Ly253-G2 and LP3783 were in solution at various concentrations as indicated. Panel B: Clones Ly612, Ly613, Ly616, Ly617, Ly253-G2 and LP3783 were cocultured with B7H3 overexpressing CHO-K1 cells at various concentrations as indicated. Panel C: Clones Ly610, Ly611, Ly614, Ly615, TM740, and Ly253-G2 were in solution at various concentrations as indicated. Panel D: Clones Ly610, Ly611, Ly614, Ly615, TM740, and Ly253-G2 were cocultured with B7H3 overexpressing CHO-K1 cells at various concentrations as indicated. Panel E: Clones Ly614, Ly615, Ly616, Ly617. Ly805, Ly806, Ly807, Ly808, Ly813, Ly814, Ly815, Ly816, Ly181, Ly387, TM559 and Ly253-G2 were in solution at various concentrations as indicated. Panel F: Clones Ly614, Ly615, Ly616, Ly617. Ly805, Ly806, Ly807, Ly808, Ly813, Ly814, Ly815, Ly816, Ly181, Ly387, TM559 and Ly253-G2 were cocultured with B7H3 overexpressing CHO-K1 cells at various concentrations as indicated. Panel G: Clones Ly801, Ly802, Ly803, Ly804, Ly805, Ly806, Ly807, Ly808, Ly181, Ly387, Ly383, TM559 and Ly253-G2 were in solution at various concentrations as indicated. Panel H: Clones Ly801, Ly802, Ly803, Ly804, Ly805, Ly806, Ly807, Ly808, Ly181, Ly387, Ly383, TM559 and Ly253-G2 were cocultured with B7H3 overexpressing CHO-K1 cells at various concentrations as indicated. Panel I: Clones Ly809, Ly810, Ly811, Ly812, Ly813, Ly814, Ly815, Ly816, Ly181, Ly387, Ly383, TM559 and Ly253-G2 were in solution at various concentrations as indicated. Panel J: Clones Ly809, Ly810, Ly811, Ly812, Ly813, Ly814, Ly815, Ly816, Ly181, Ly387, Ly383, TM559 and Ly253-G2 were cocultured with B7H3 overexpressing CHO-K1 cells at various concentrations as indicated.

FIGS. 37A-37D are charts showing the activity of a number of anti-B7H3/CD40 bispecific antibodies on the proliferation of human B cells from two healthy donors. The various antibodies are indicated on the x-axis, and the proliferation of human B cells are indicated by the signal of luminescence (RLU) on the y-axis. 37A: donor 1. 37B: donor 2. 37C: donor 1. 37D: donor 2.

Figure 38:
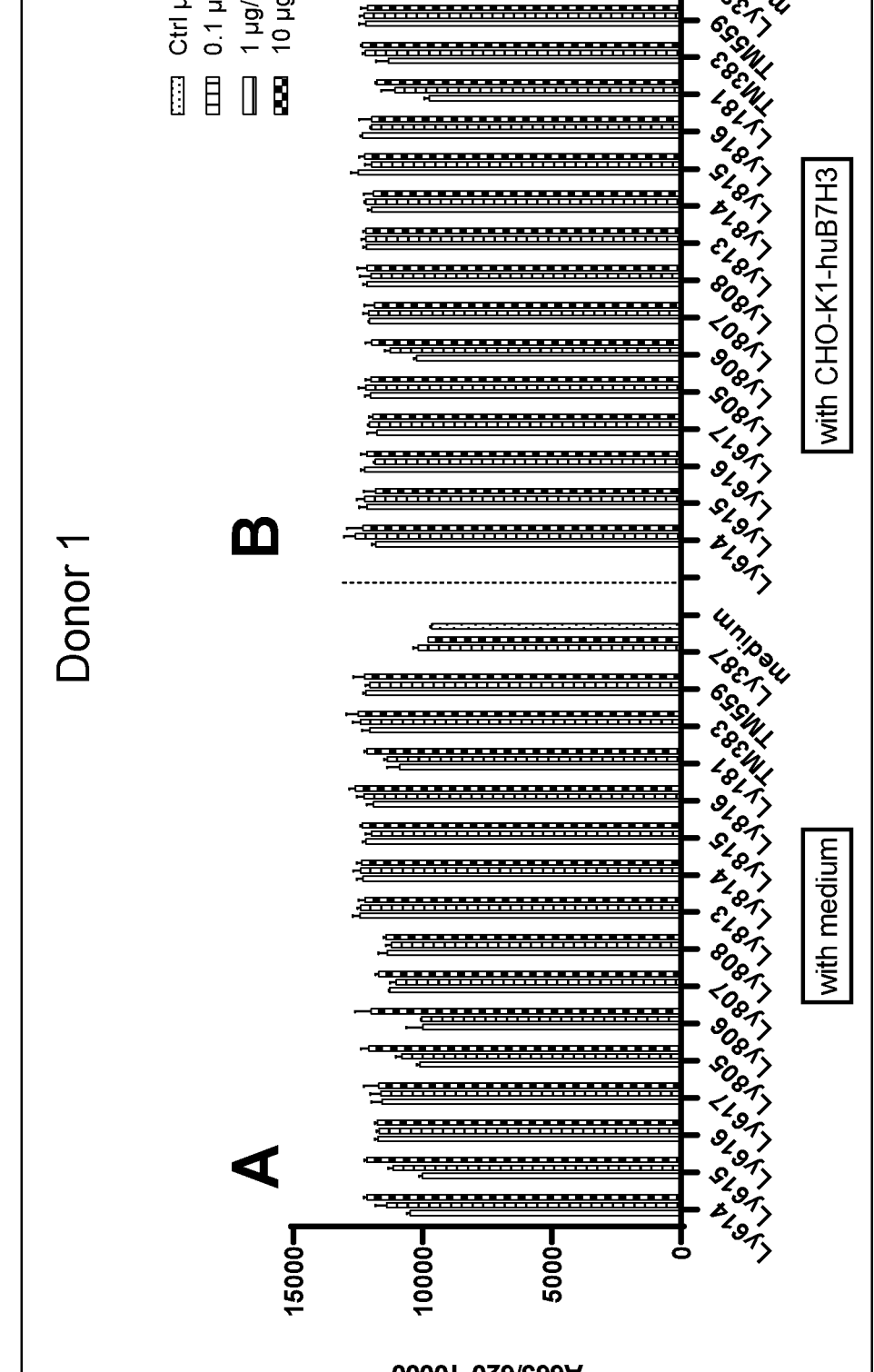
Figure 38:
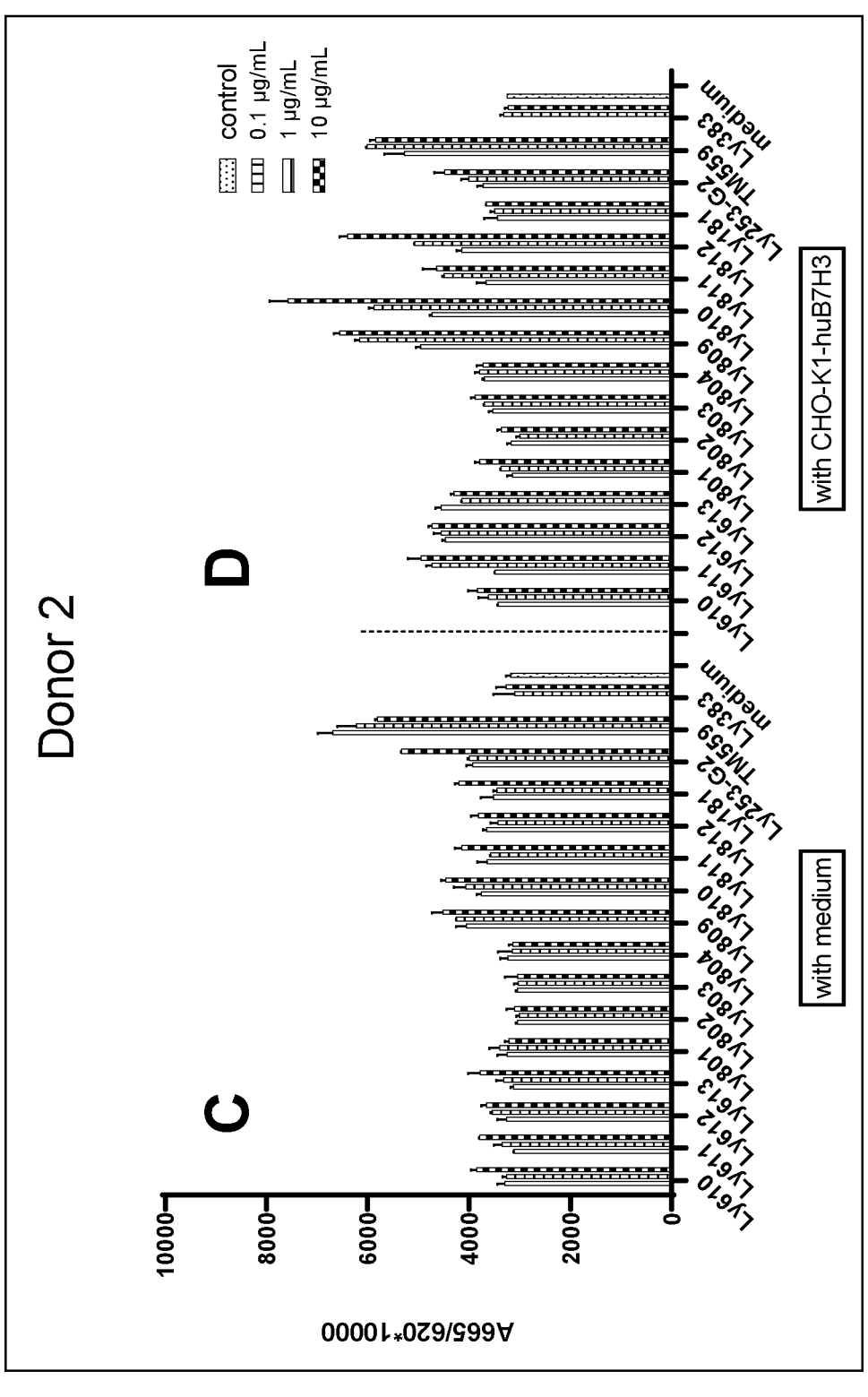
Figure 39A:
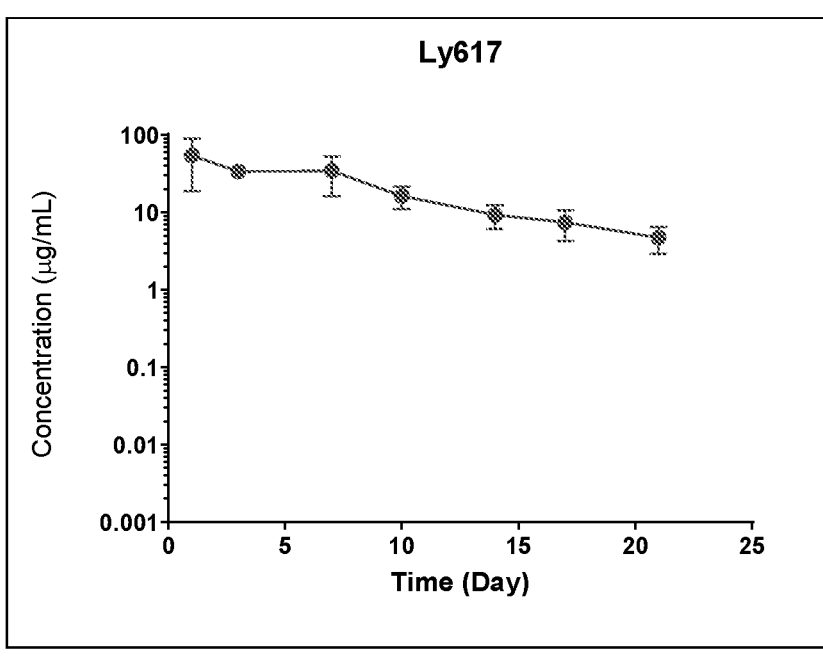
Figure 39B:
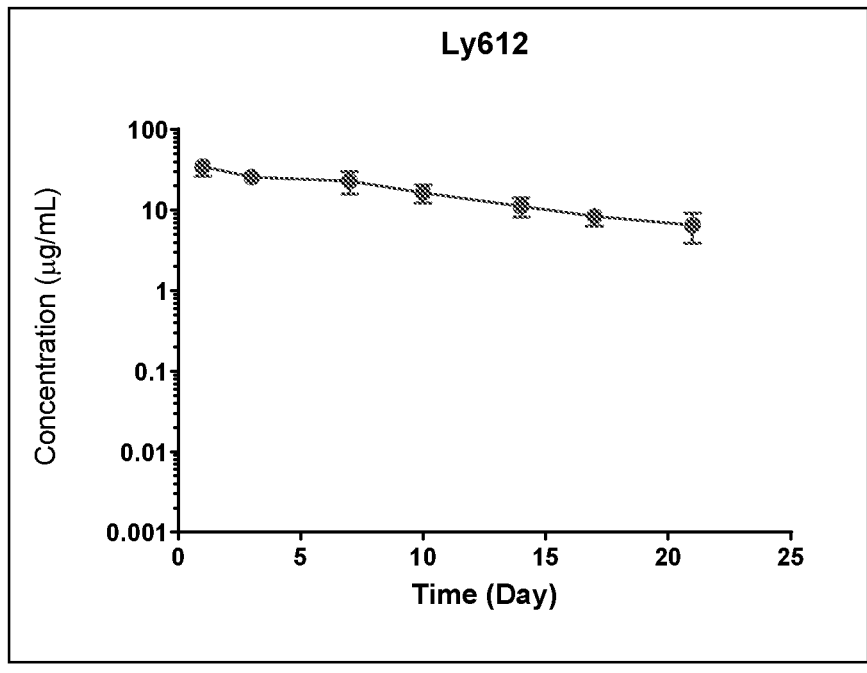
Figure 39C:
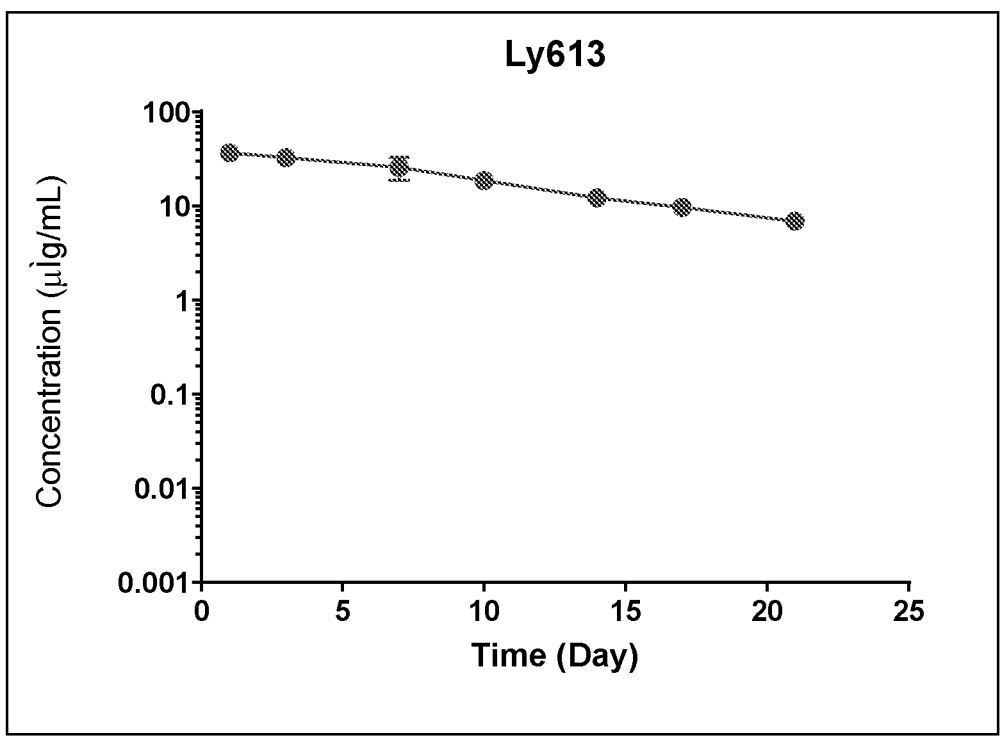
Figure 39D:
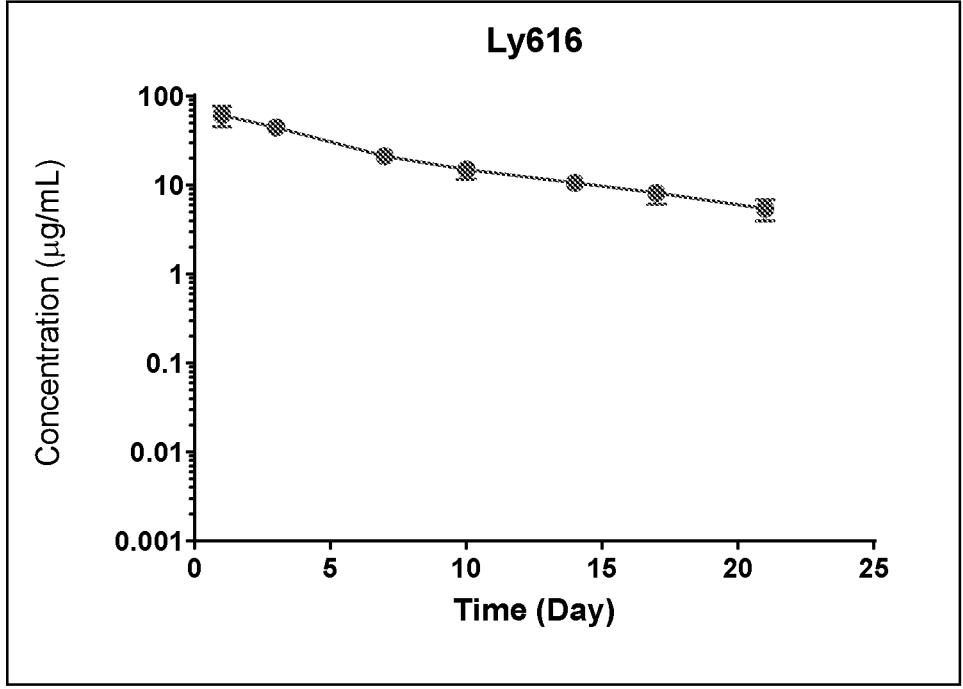
Figure 39E:
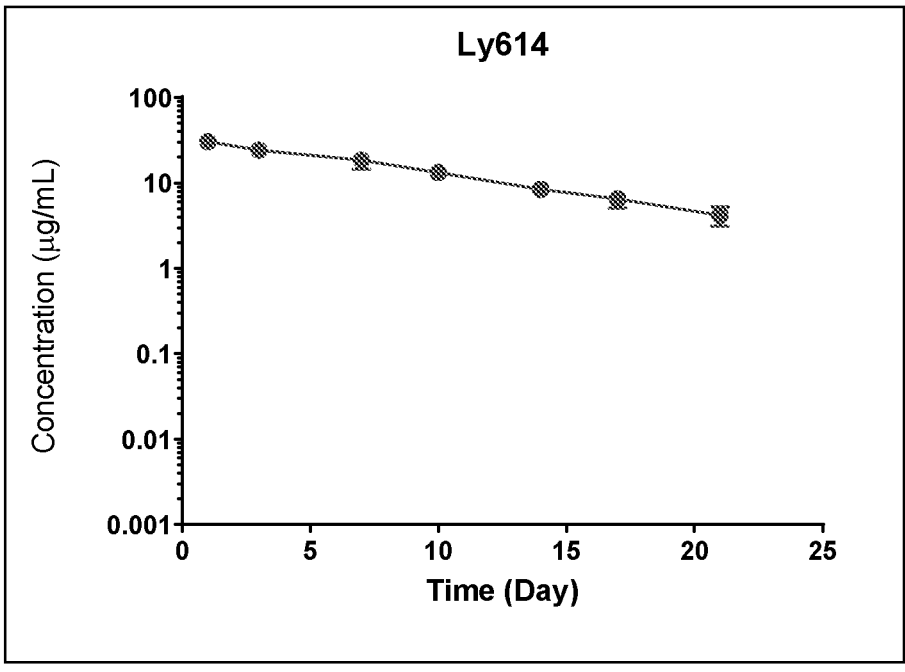
Figure 39F:
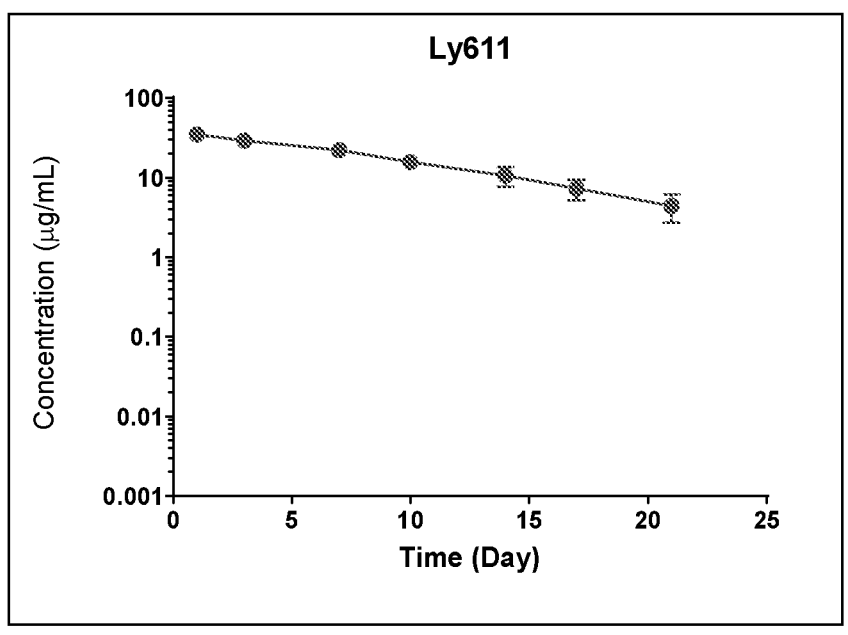
Figure 39G:
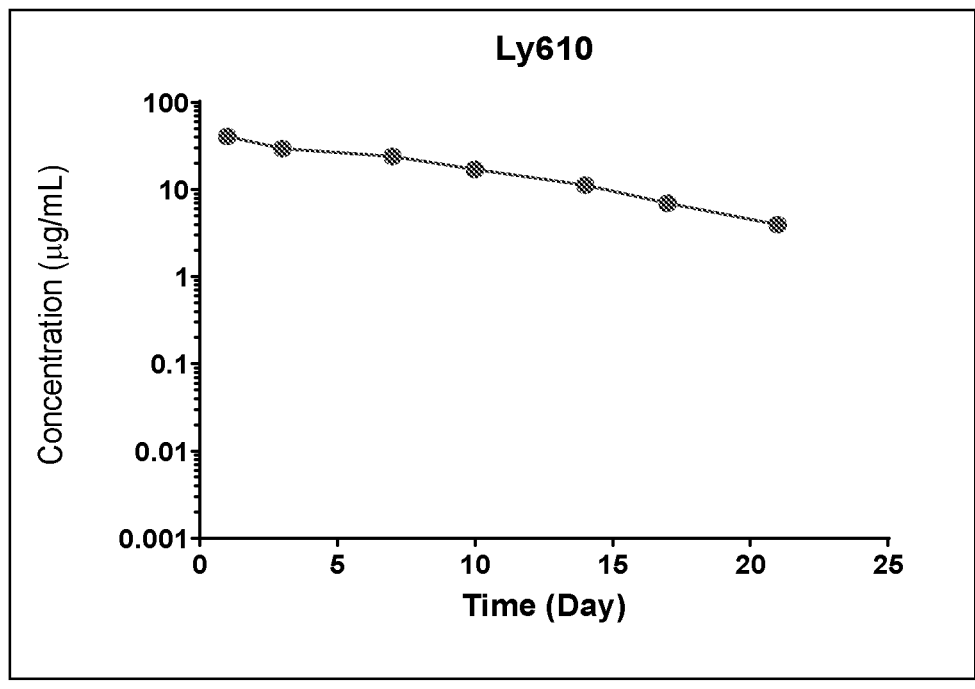
Figure 39H:
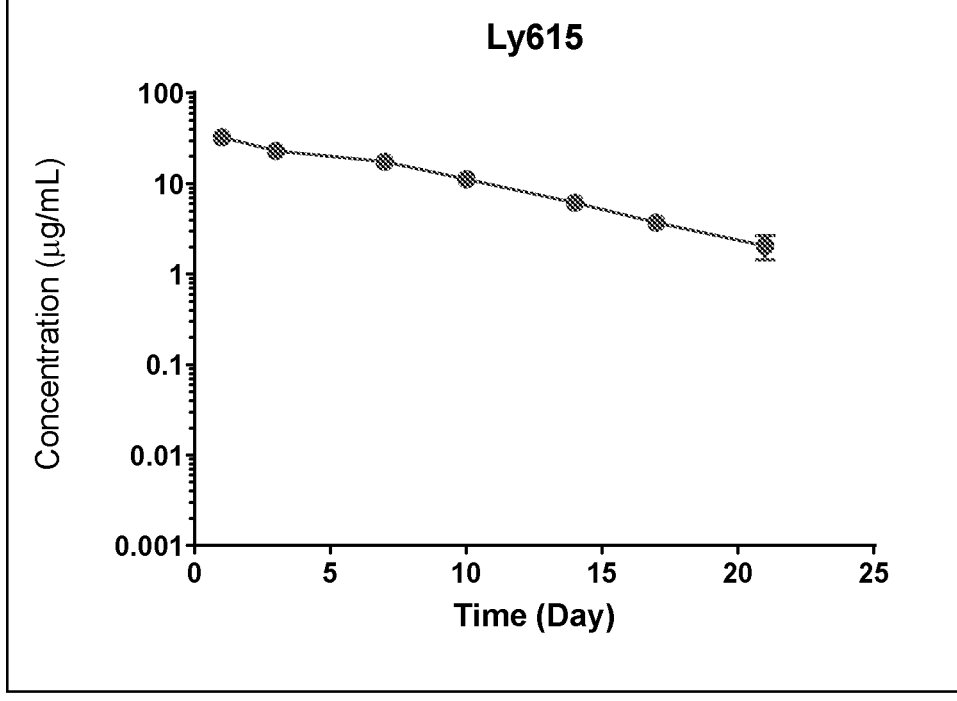

FIG. 38 include a set of bar graphs showing the activity of exemplary anti-B7H3/CD40 antibodies in activation of human dendritic cells (DC) from two healthy donors by the antibodies either in solution (Panel A and Panel C) or in co-culture of CHO cells expressing human B7H3 (Panel B and Panel D). DC activation is indicated by the bar graphs signal of IL-8 in the culture supernatant.

FIGS. 39A-39H include a set of graphs showings pharmacokinetics of anti-B7H3/CD40 bispecific antibodies as indicated in mice. Exemplary clones include clones Ly617 (39A), Ly612 (39B), Ly613 (39C) and Ly616 (39D), Ly614 (39E), Ly611 (39F), Ly610 (39G) and Ly615 (39H).

Figure 40A:
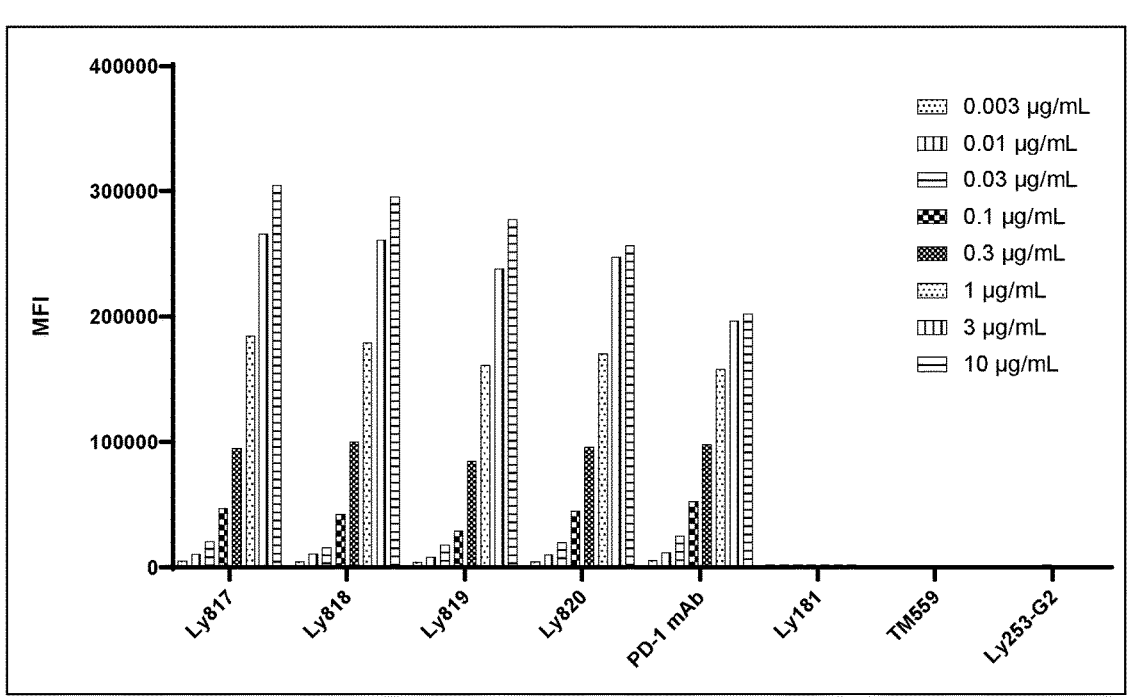
Figure 40B:
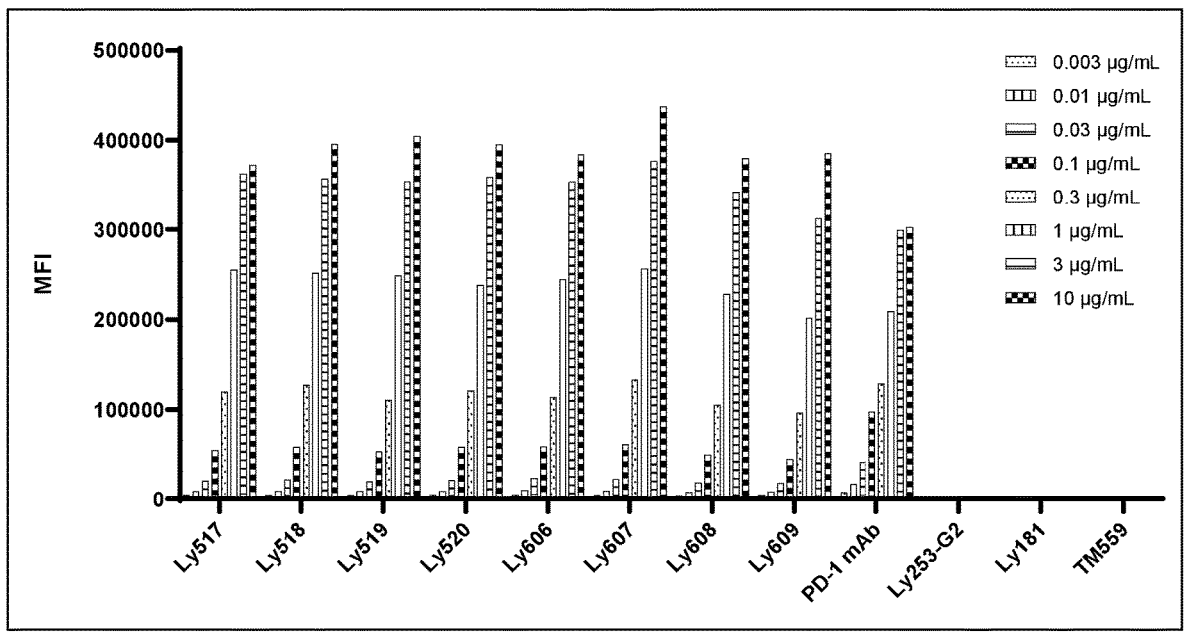

FIGS. 40A-40B are charts showing PD-1 binding activity of anti-PD-1/CD40 bispecific antibodies as indicated on the x-axis to human PD-1 expressed on CHO cells. The bars labeled "IgG control" served as controls. Binding of these anti-PD-1/CD40 bispecific antibodies are indicated by the mean fluorescence intensity (MFI) on the y-axis. 40A: Clones Ly817, Ly818, Ly819, Ly820, PD-1 mAb, Ly181, TM559 and Ly253-G2 at various concentrations as indicated. 40B: Clones Ly517, Ly518, Ly519, Ly520, Ly606, Ly607, Ly608, Ly609, PD-1 mAb, TM559 and Ly253-G2 at various concentrations as indicated.

Figure 41A:
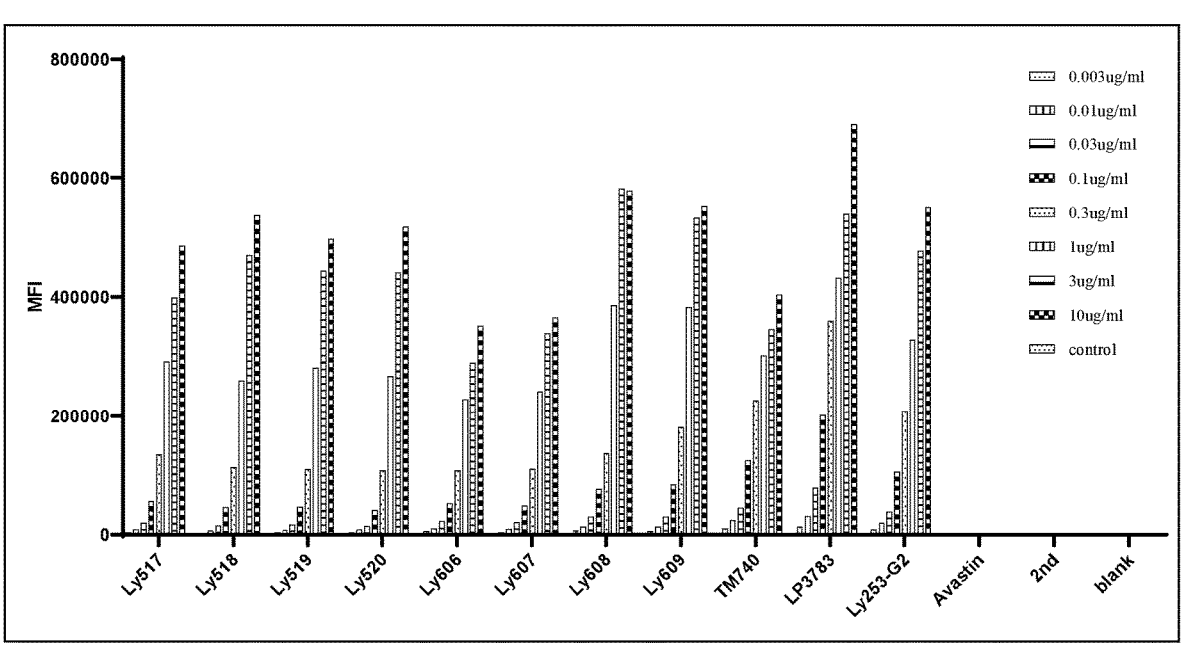
Figure 41B:
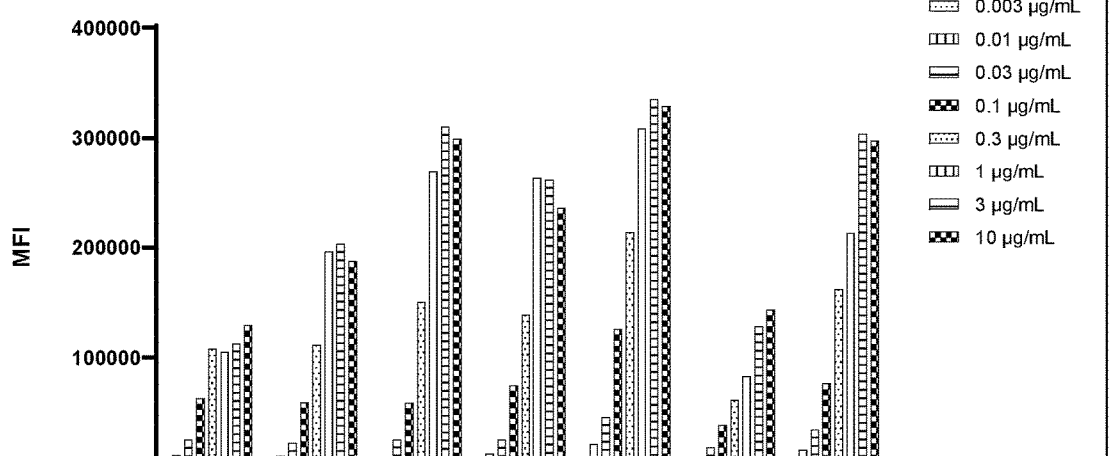
Figure 42A:
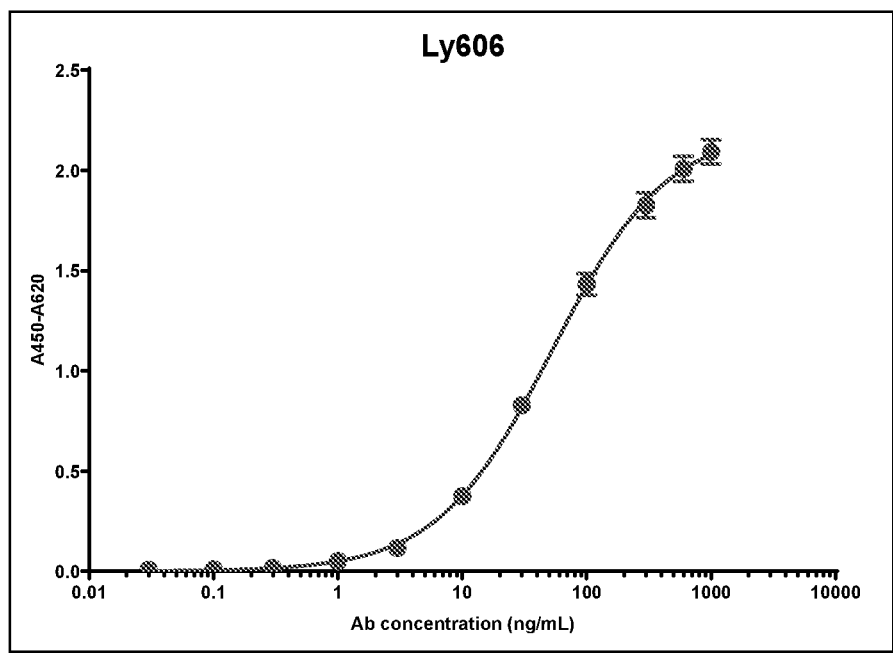
Figure 42B:
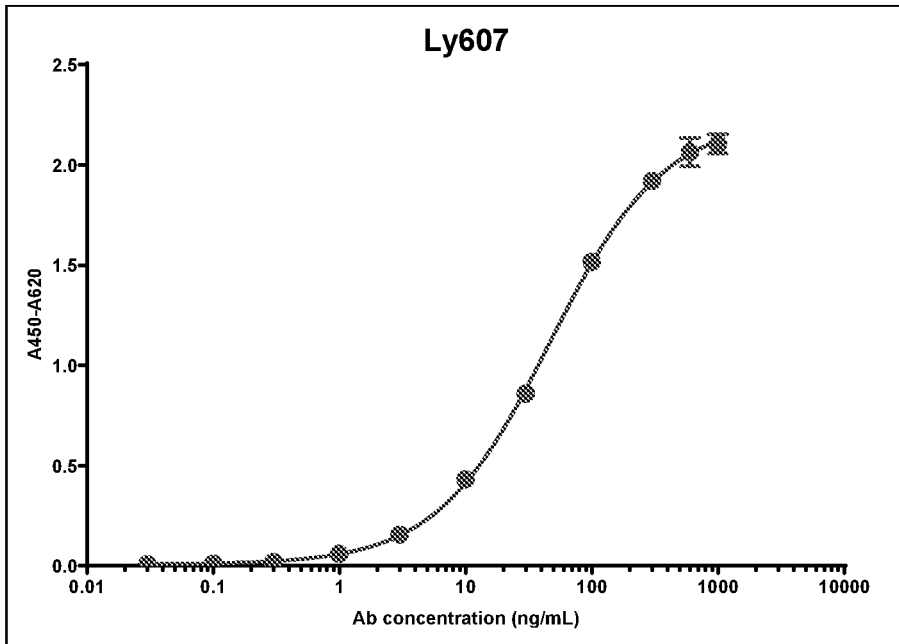
Figure 42C:
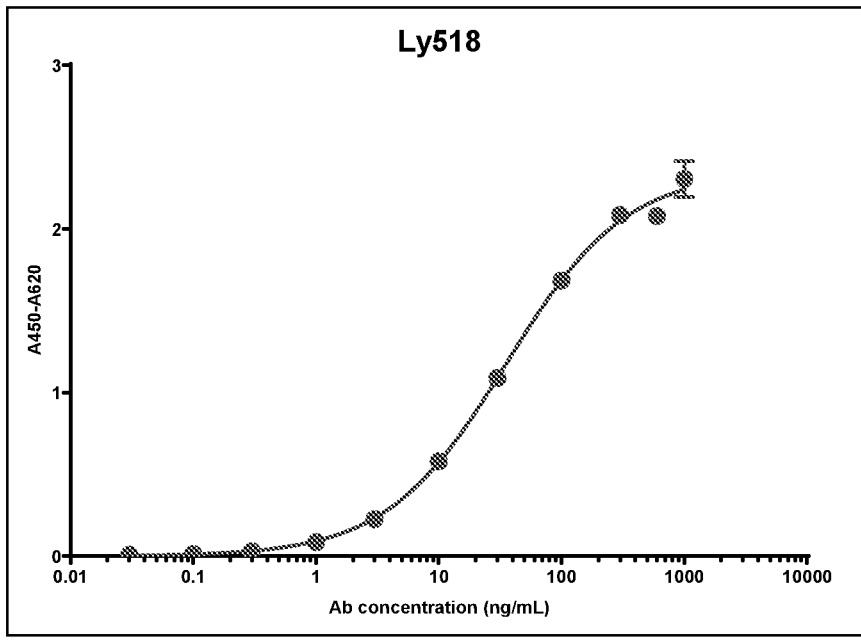
Figure 42D:
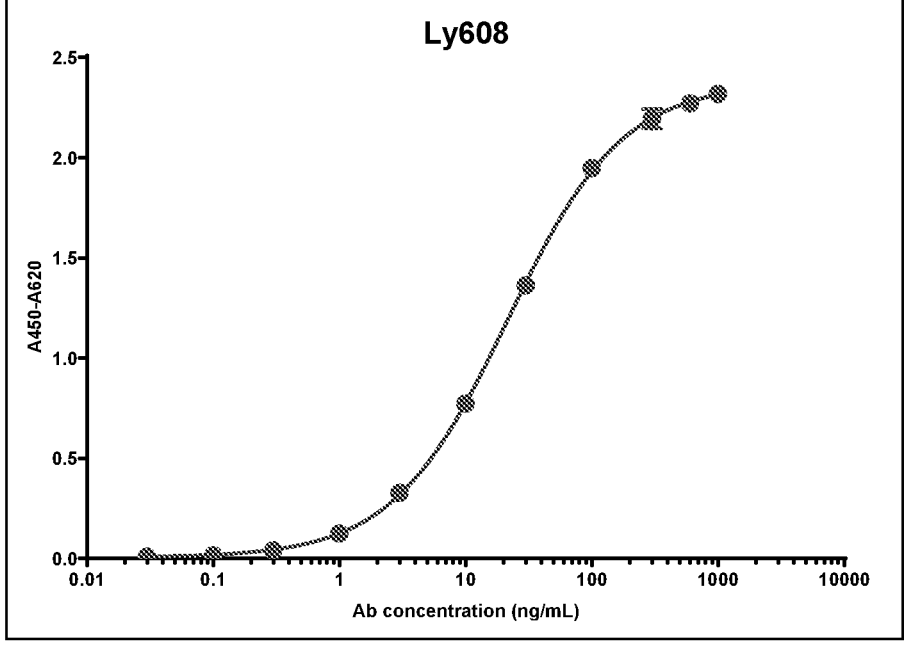
Figure 42E:
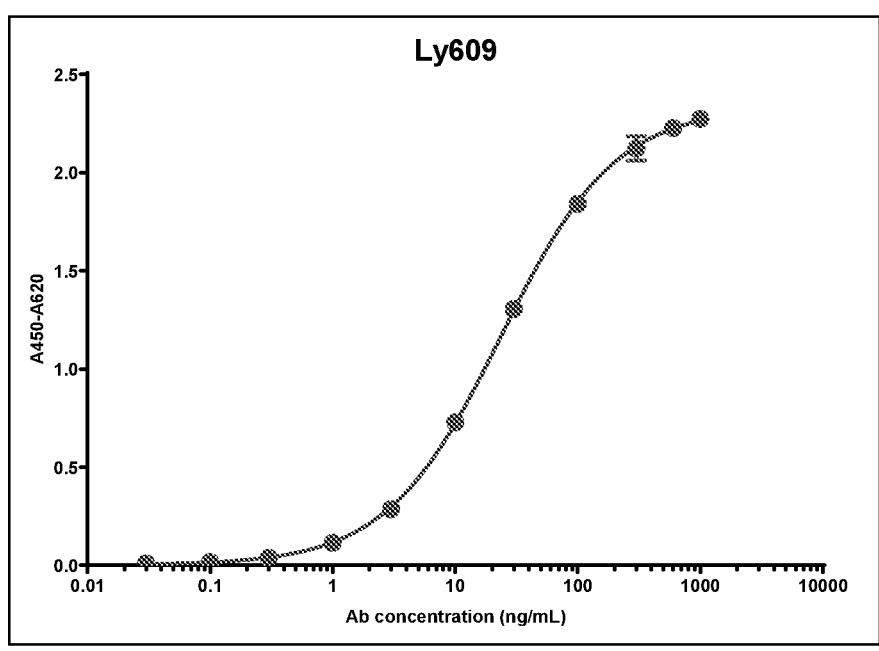
Figure 42F:
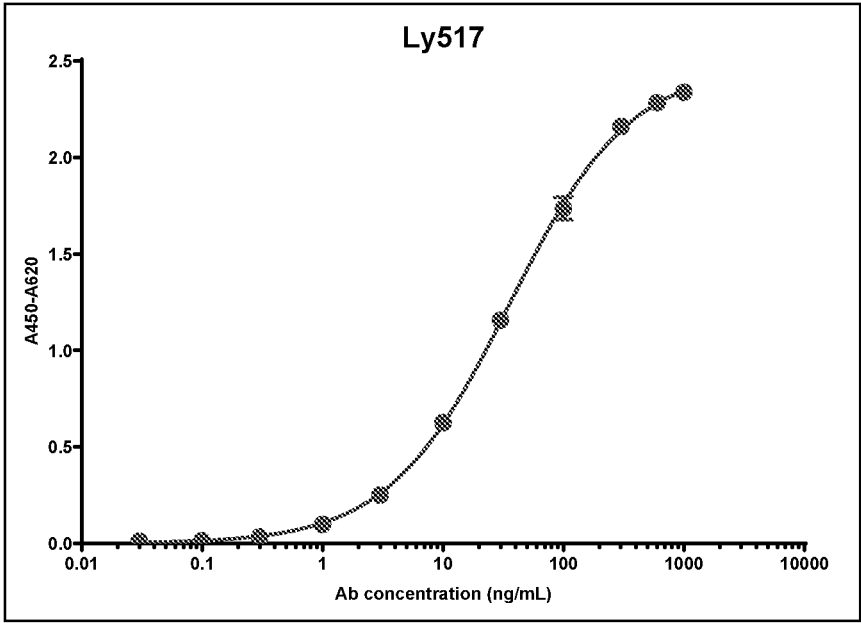
Figure 42G:
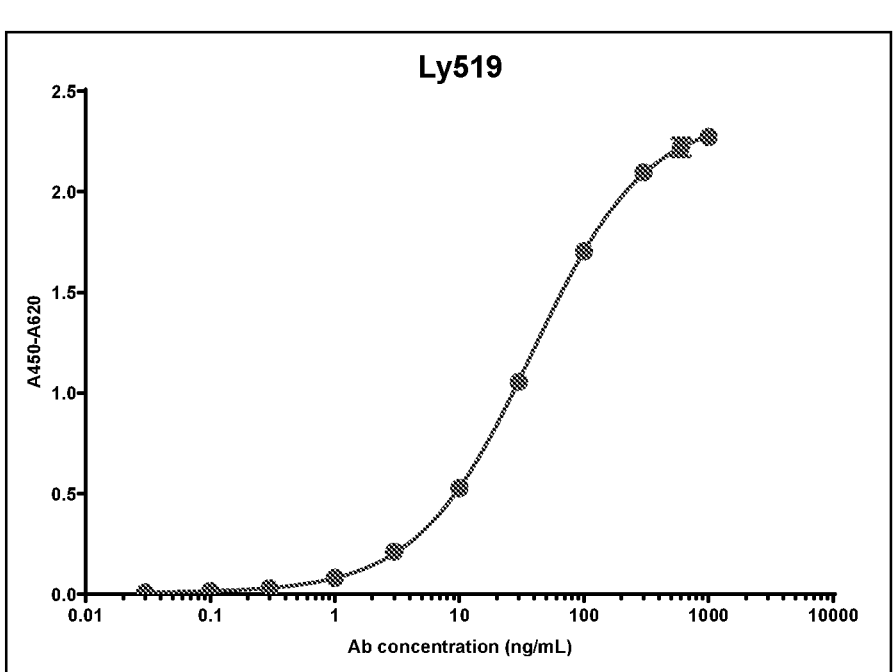
Figure 42H:
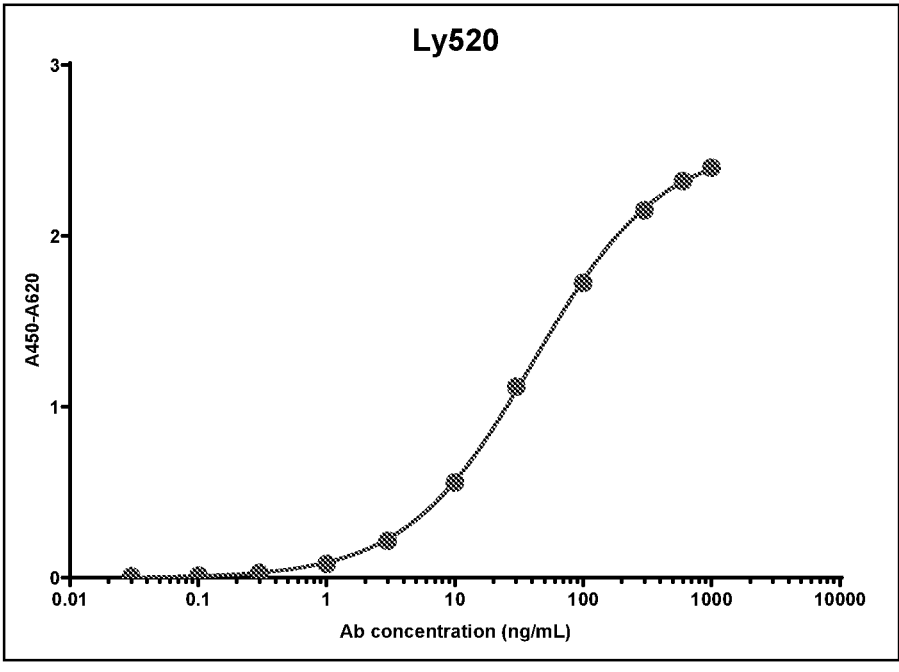
Figure 43A:
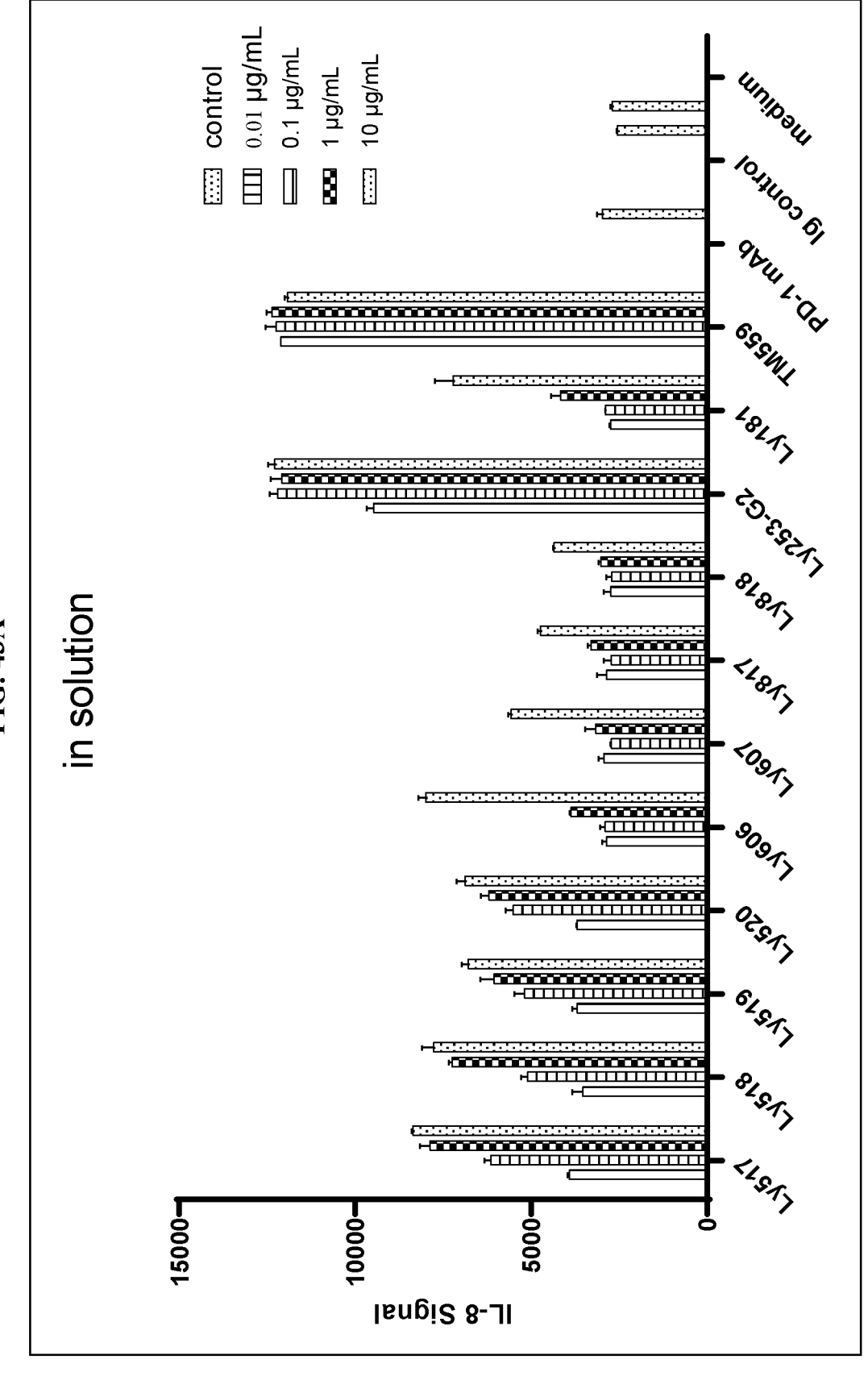
Figure 43B:
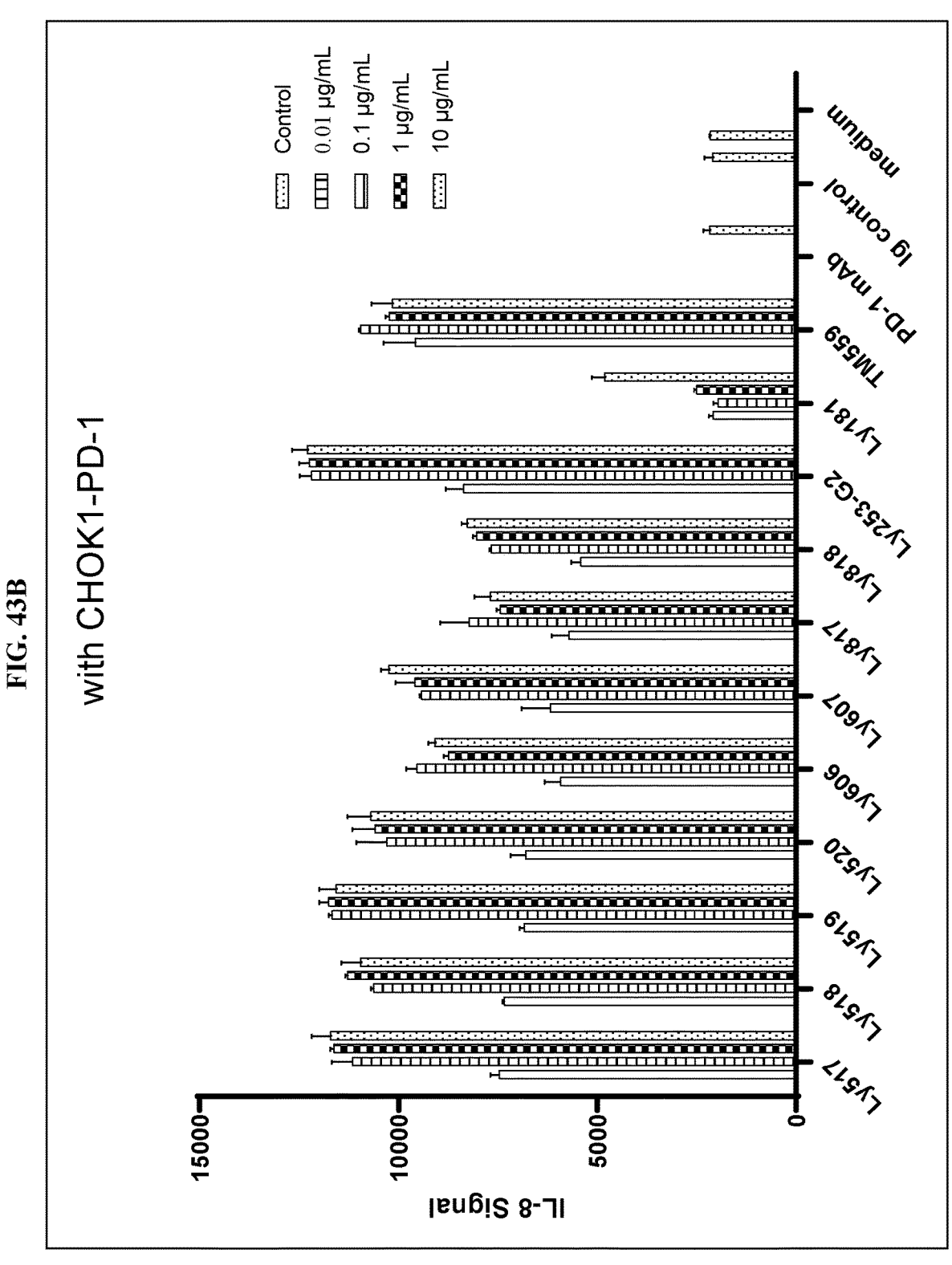
Figure 43C:
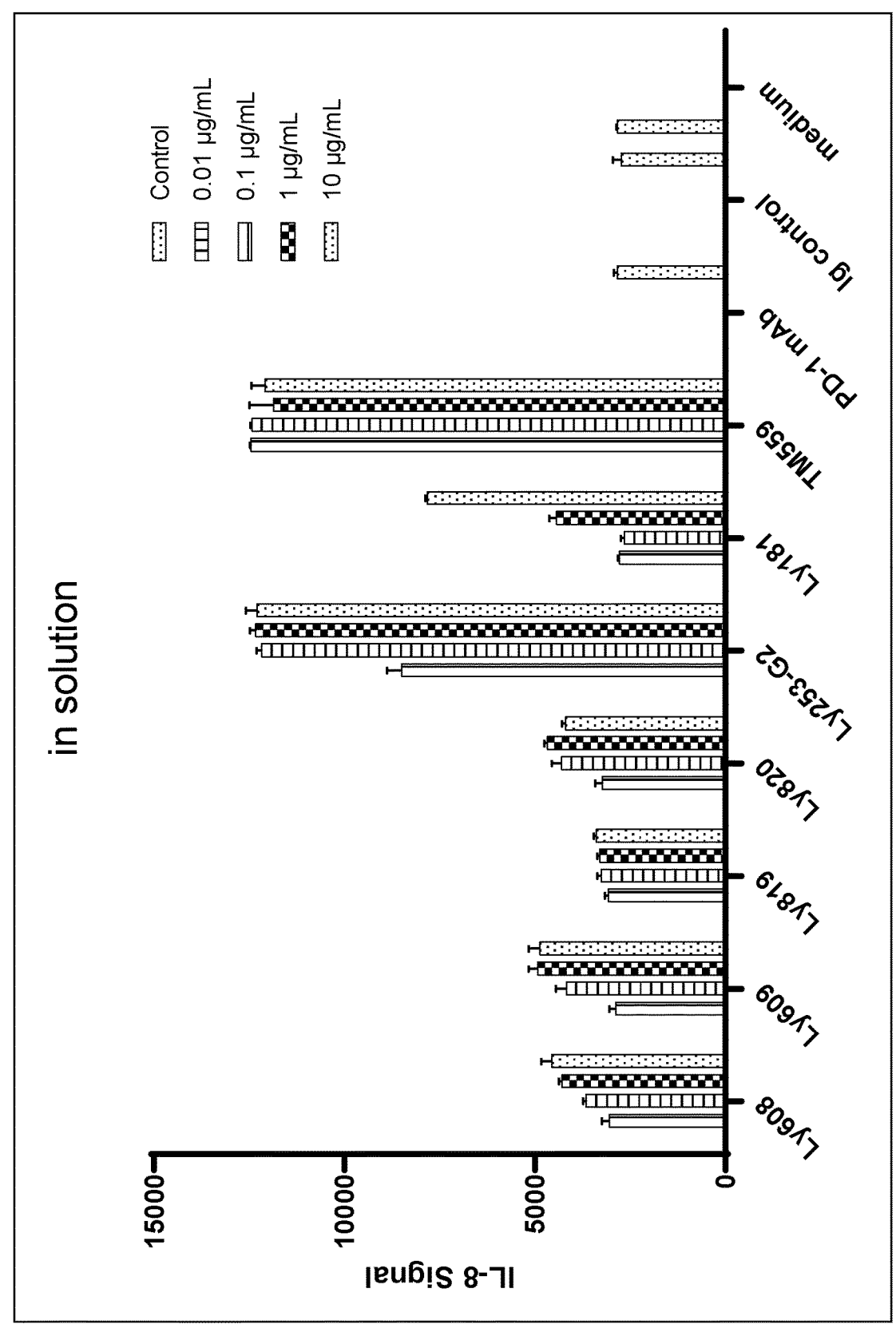
Figure 43D:
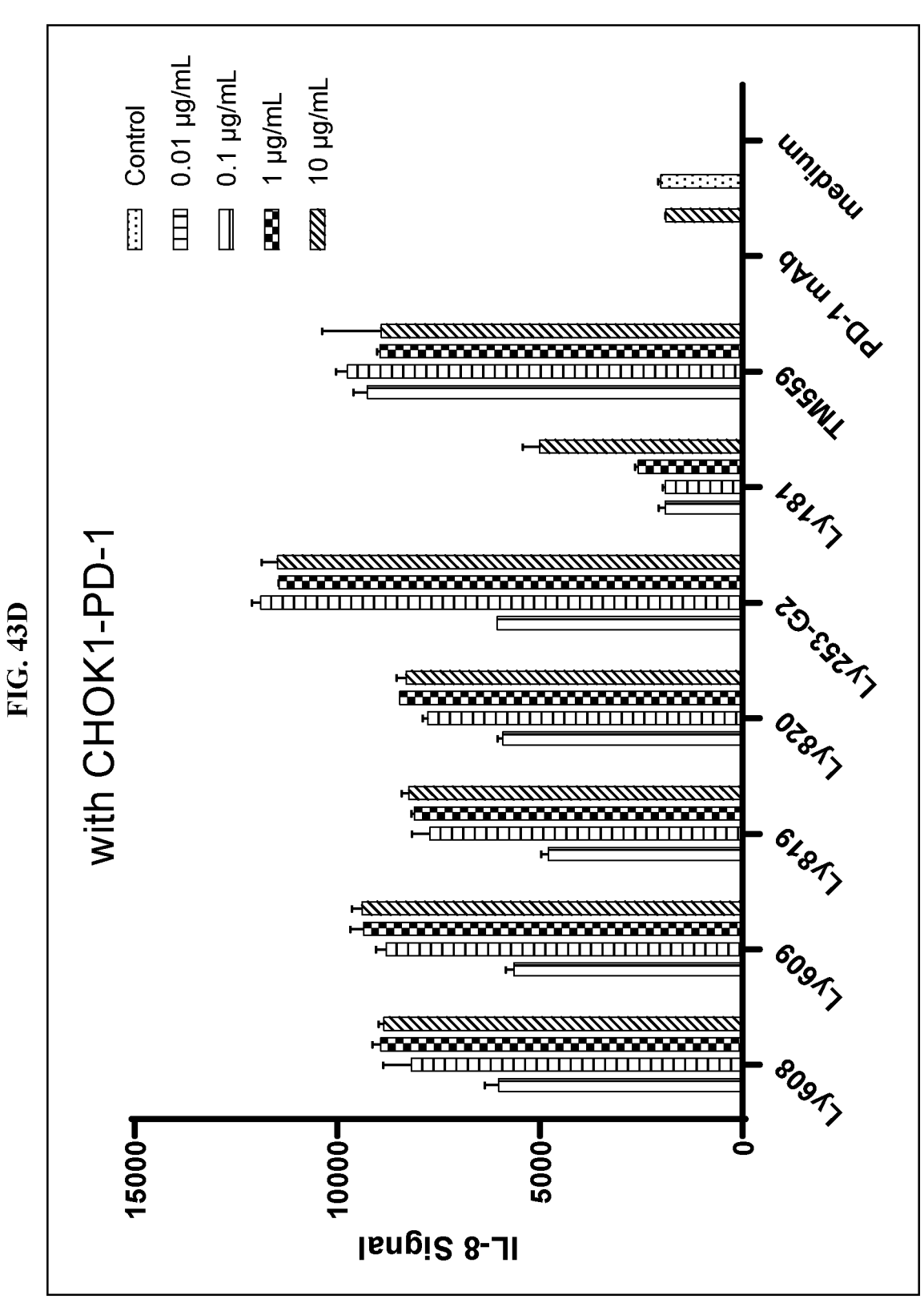

FIGS. 41A-41B are charts showing CD40 binding activity of anti-PD-1/CD40 bispecific antibodies as indicated on the x-axis to human CD40 expressed on CHO cells. Ly076 was used as controls. Binding of these anti-PD-1/CD40 bispecific antibodies are indicated by the mean fluorescence intensity (MFI) on the y-axis. 41A: Clones Ly517, Ly518, Ly519, Ly520, Ly606, Ly607, Ly608, Ly609, TM740, Ly3783 and Ly253-G2 at various concentrations as indicated. 41B: Clones Ly817, Ly818, Ly819, Ly820, Ly181, TM559 and Ly253-G2 at various concentrations as indicated.

FIGS. 42A-42H are charts showing simultaneously binding of exemplary anti-PD-1/CD40 antibodies to recombinant human PD-1 and CD40 proteins. Clones Ly606 (42A), Ly607 (42B), Ly518 (42C). Ly608 (42D), Ly609 (42E) and Ly517 (42F), Ly519 (42G), and Ly520 (42H) at various concentrations as indicated.

FIGS. 43A-43D are charts showing stimulation of human CD40 activation as indicated by IL8 secretion in a reporter assay by a number of anti-PD-1/CD40 antibodies. The agonistic activity of these bispecific antibodies was evaluated either in solution, or co-cultured with PD-1 overexpressing CHO cells. The various antibodies are indicated on the x-axis, and the CD40 activation signal are indicated on the y-axis. The bars labeled as "IgG control" and "Mediun" served as controls. 43A: Clones Ly517, Ly518, Ly519, Ly520, Ly606, Ly607, Ly817, Ly818, Ly253-G2, Ly181, TM559 and PD-1 mAb were in solution at various concentrations as indicated. 43B: Clones Ly517, Ly518, Ly519, Ly520, Ly606, Ly607, Ly817, Ly818, Ly253-G2, Ly181, TM559 and PD-1 mAb were cocultured with PD-L1 overexpressing CHO-K1 cells at various concentrations as indicated. 43C: Clones Ly608, Ly609, Ly819, Ly820, Ly253-G2, Ly181, TM559 and PD-1 mAb were in solution at various concentrations as indicated. 43D: Clones Ly608, Ly609, Ly819, Ly820, Ly253-G2, Ly181, TM559 and PD-1 mAb were cocultured with PD-1 overexpressing CHO-K1 cells at various concentrations as indicated.

Figure 44A:
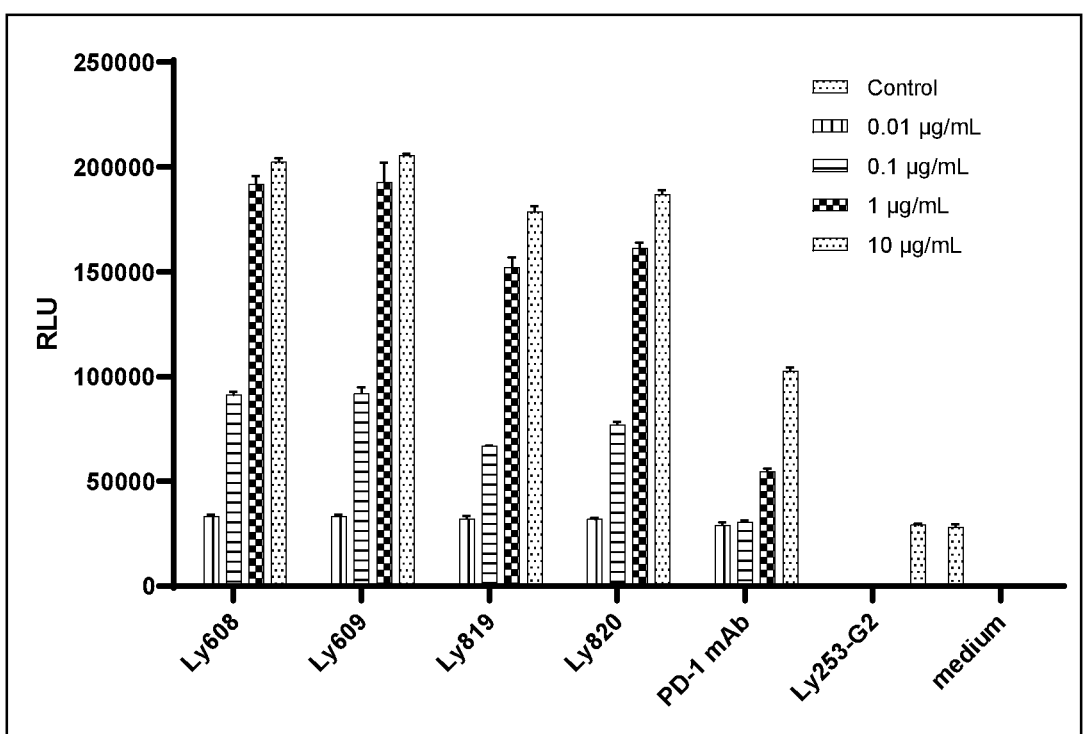
Figure 44B:
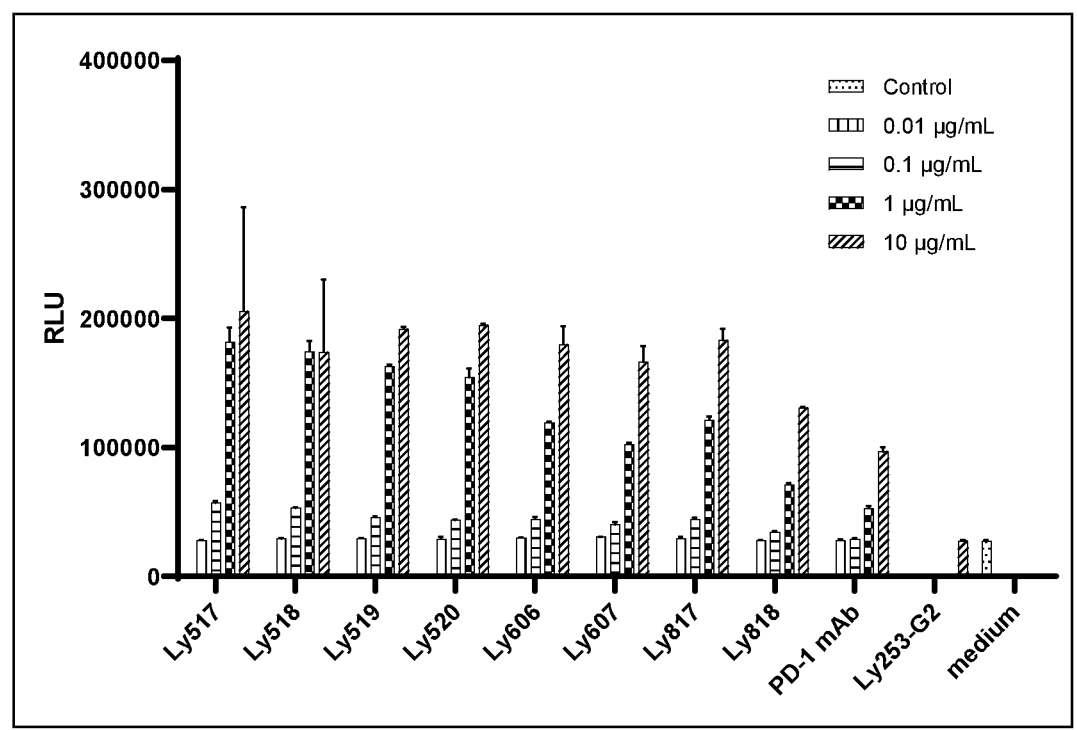

FIGS. 44A-44B are charts showing the PD-1 pathway blocking effect of anti-PD-1/CD40 bispecific antibodies. The antibodies are indicated on the x-axis, and the RLU signal on the y-axis reflects the blockade of PD-1/PD-L1 interaction leading to increased signal. 44A: blocking effects of clones Ly608, Ly609, Ly819, Ly820, Ly456, Ly458, PD-1 mAb and Ly253-G2. 44B: blocking effects of clones Ly517, Ly518, Ly519, Ly520, Ly606, Ly607, Ly817, Ly818, PD-1 mAb and Ly253-G2.

Figure 45:
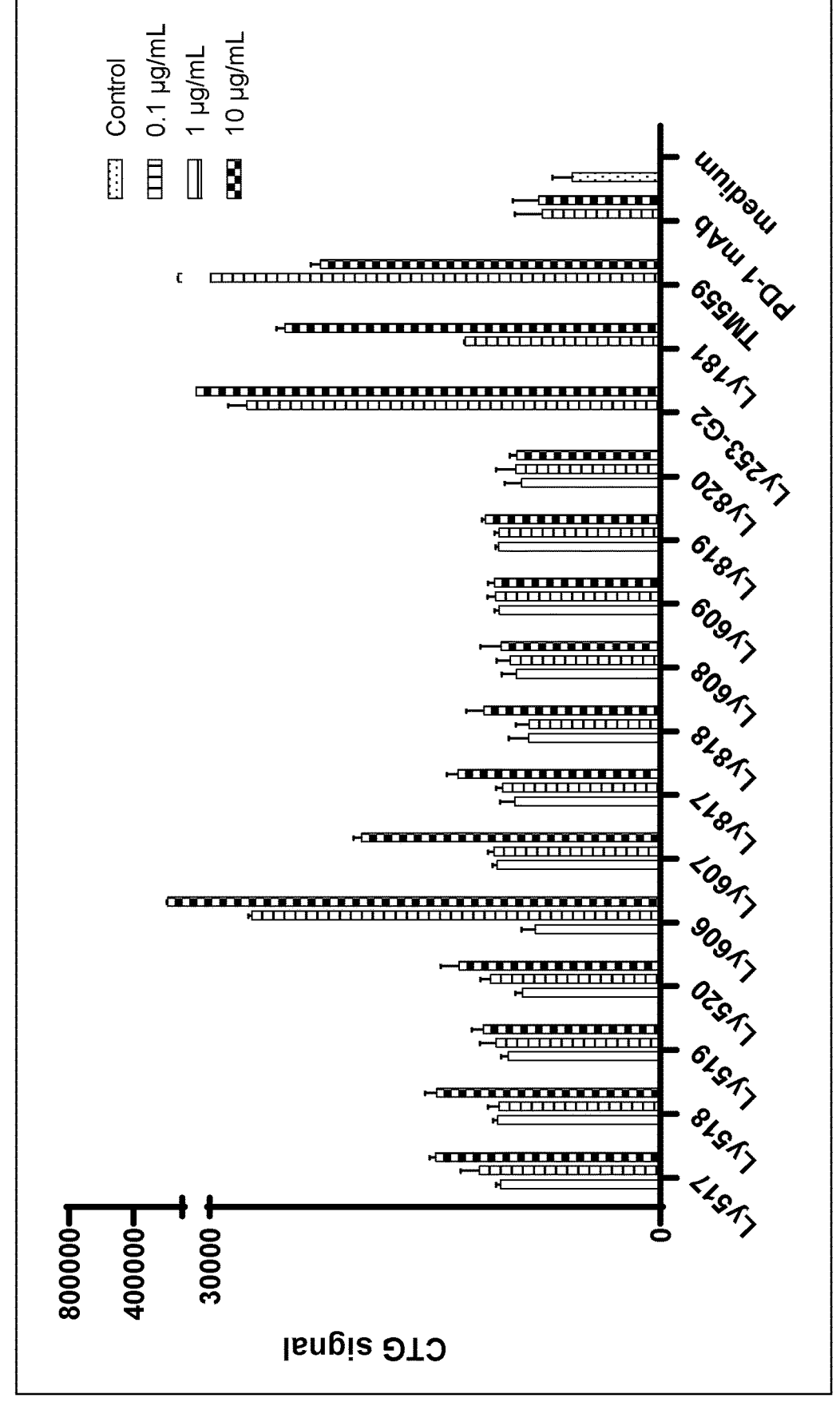
Figure 46A:
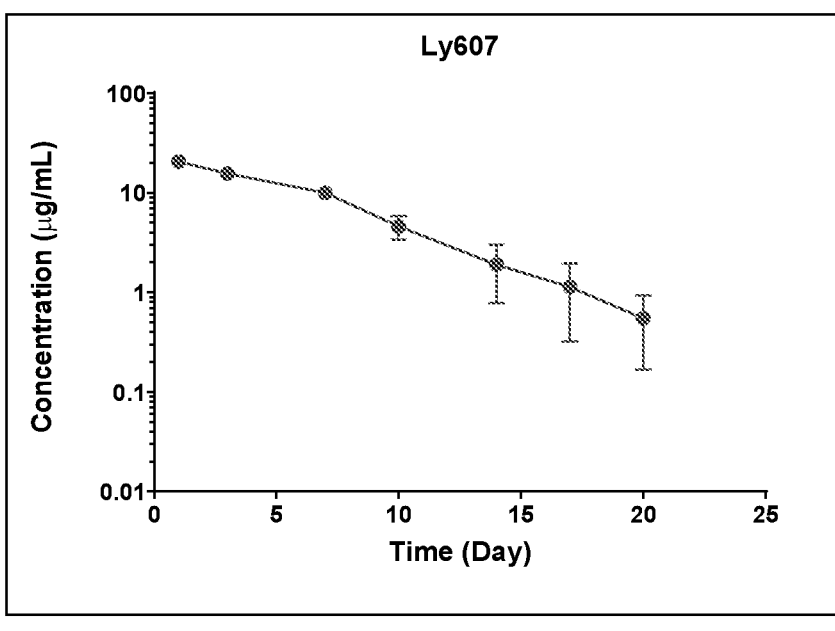
Figure 46B:
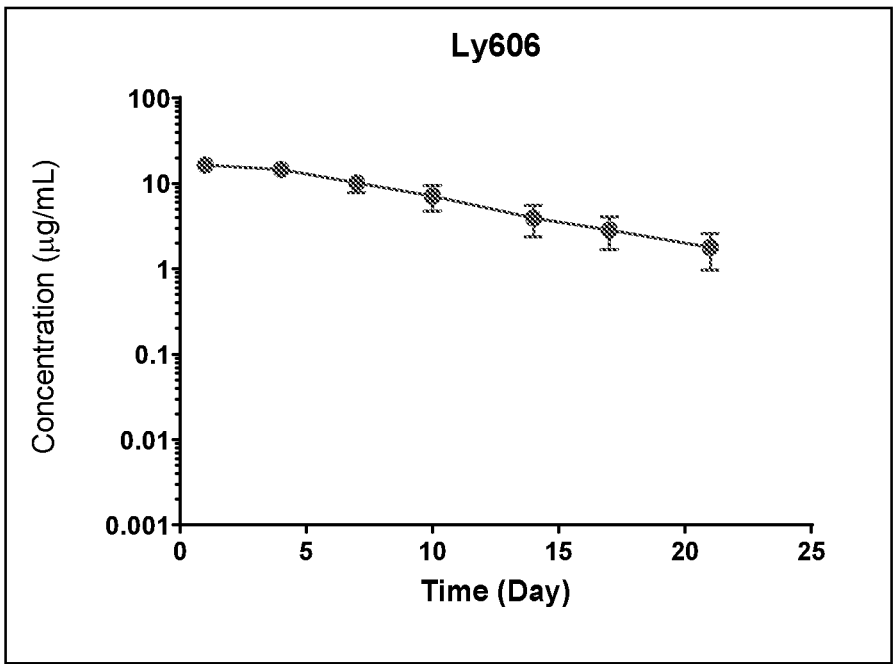
Figure 46C:
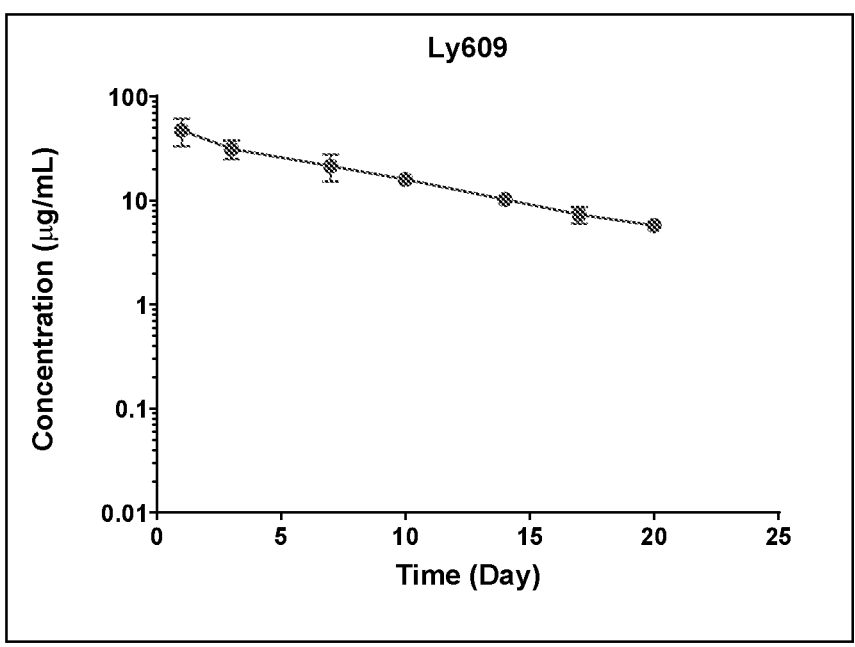
Figure 46D:
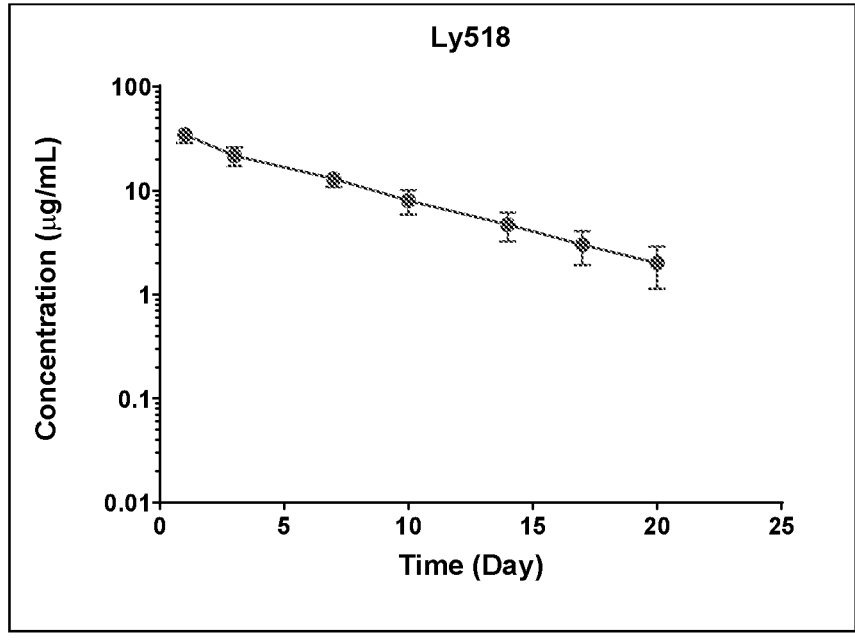
Figure 46E:
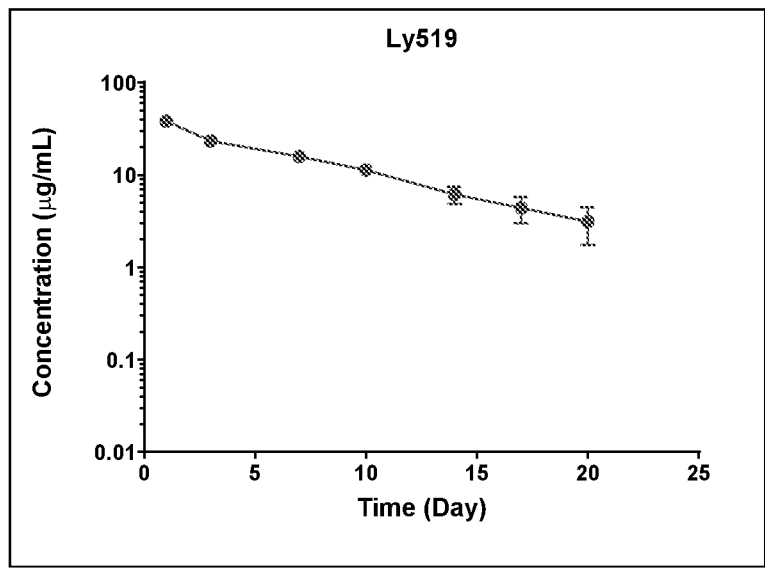
Figure 46F:
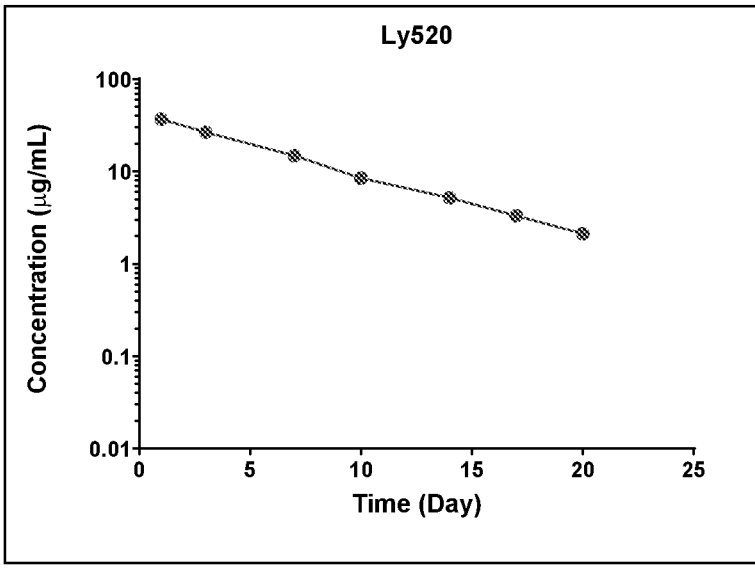
Figure 46G:
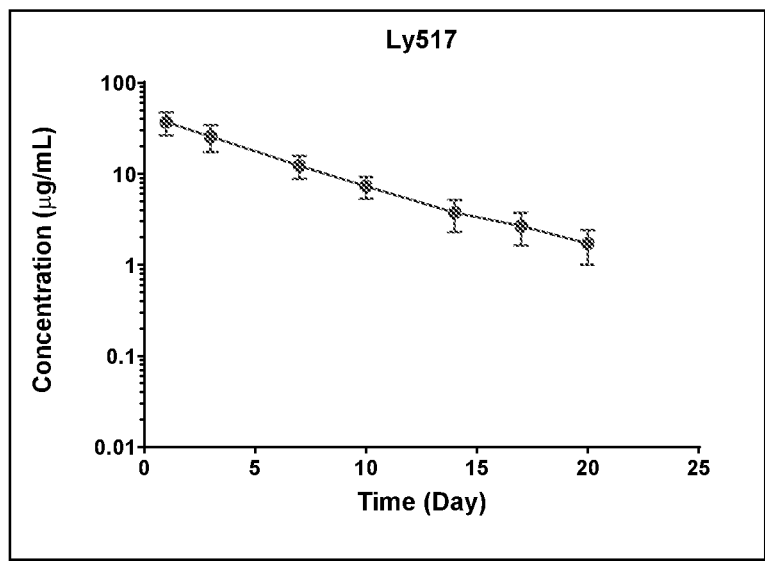
Figure 46H:
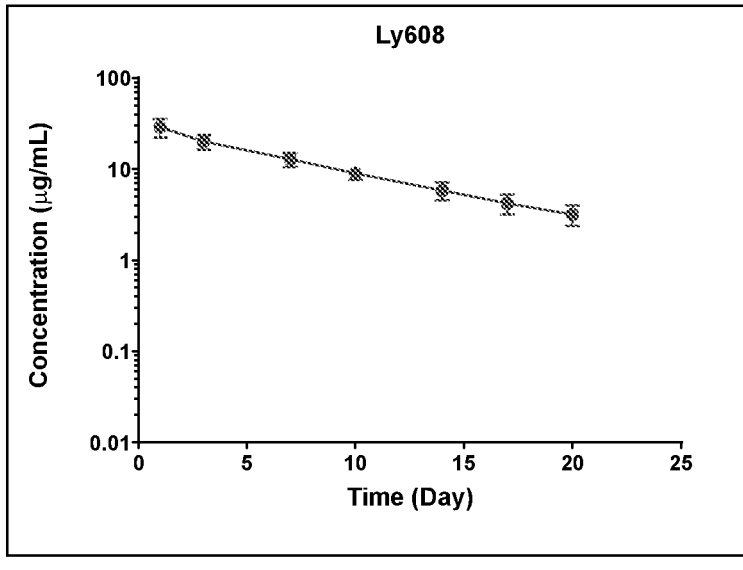

FIG. 45 is a chart showing the activity of a number of anti-PD-1/CD40 bispecific antibodies on the proliferation of human B cells from one healthy donor. The various antibodies are indicated on the x-axis, and the proliferation of human B cells are indicated by the signal of luminescence (RLU) on the y-axis.

FIGS. 46A-46H include a set of graphs showings pharmacokinetics of anti-PD-1/CD40 bispecific antibodies as indicated in mice. Exemplary clones include Ly607 (46A), Ly606 (46B), Ly609 (46C) and Ly518 (46D). Clones Ly519 (46E), Ly520 (46F), Ly517 (46G) and Ly608 (46H).

Figure 47:
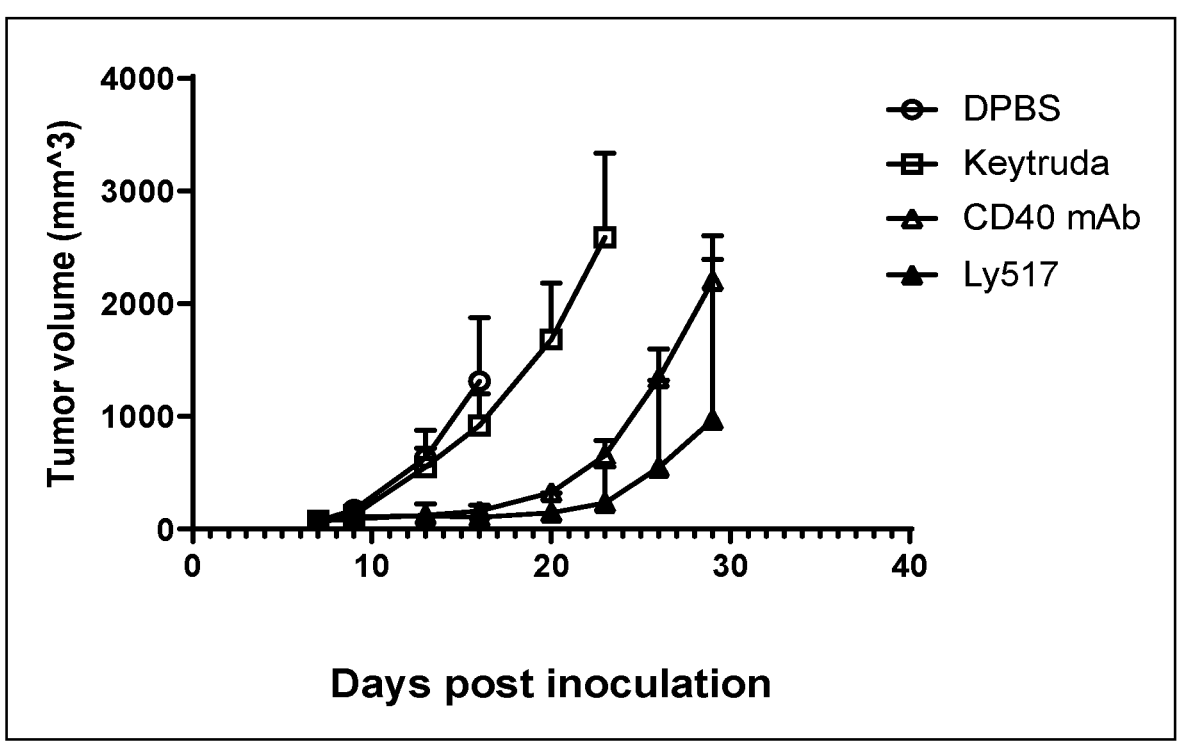

FIG. 47 is a chart showing the anti-tumor activity of anti-PD-1/CD40 antibodies in a human CD40 and human PD-1 double knock-in mouse syngeneic B16-ova model. anti-tumor effects of clones Ly517, Keytruda, and a reference CD40 mAb.

Figure 48:
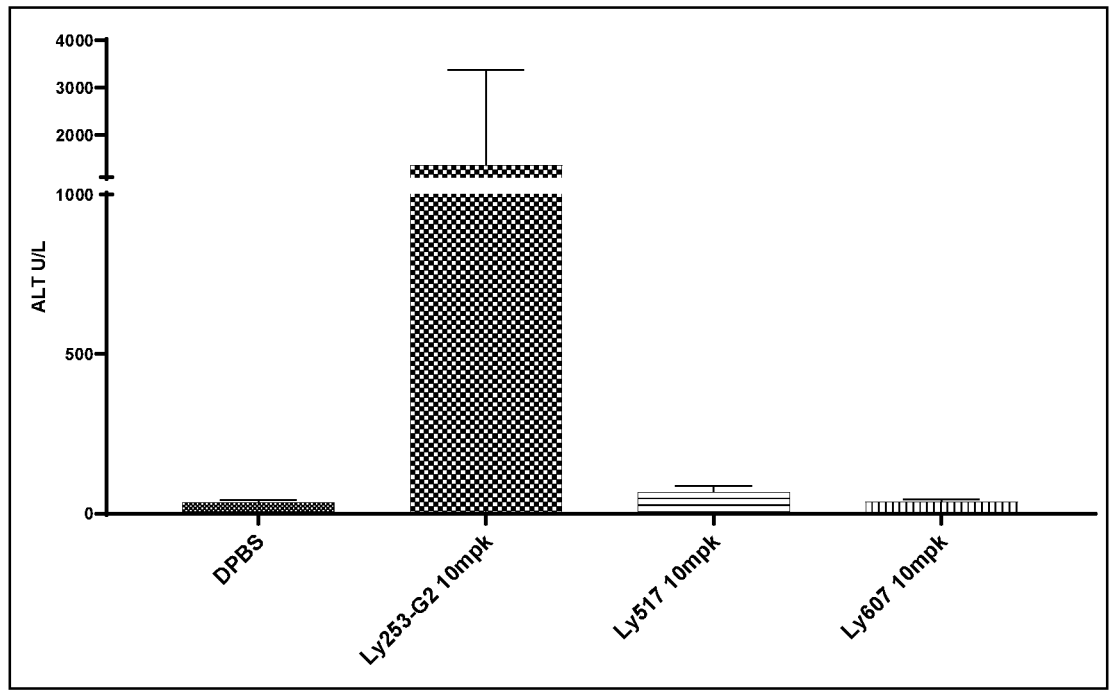

FIG. 48 is a chart showing serum alanine transaminase (ALT, a liver enzyme released into serum upon liver damage) level after treatment of antibodies as shown in homozygous B-hCD40 C57BL6 mice.

Figure 49A:
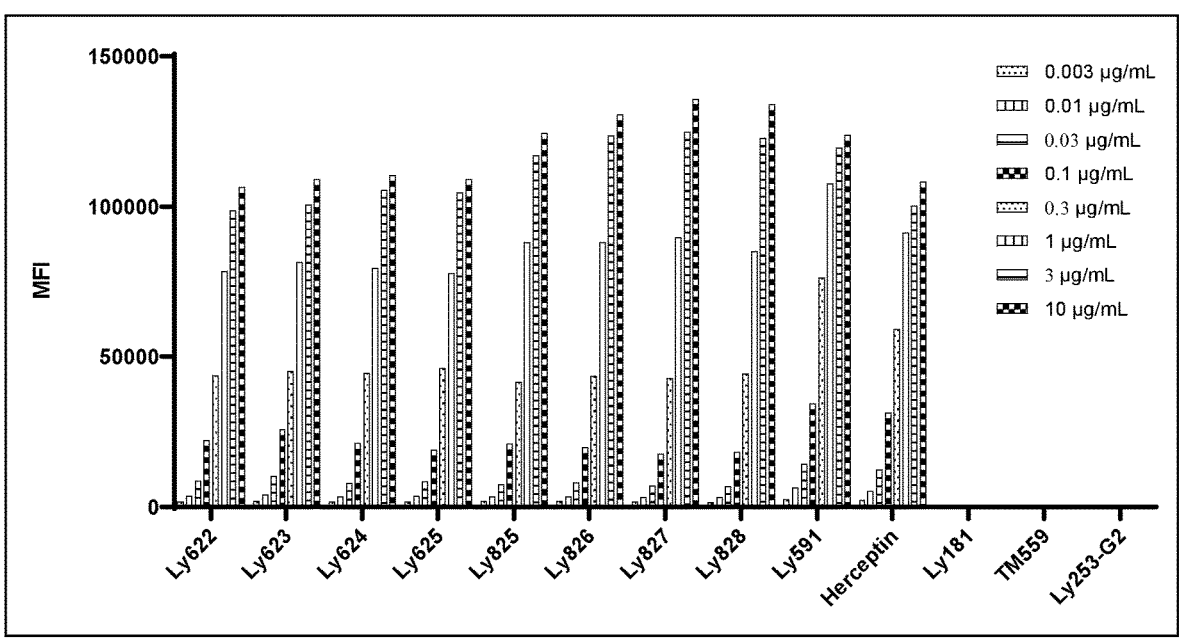
Figure 49B:
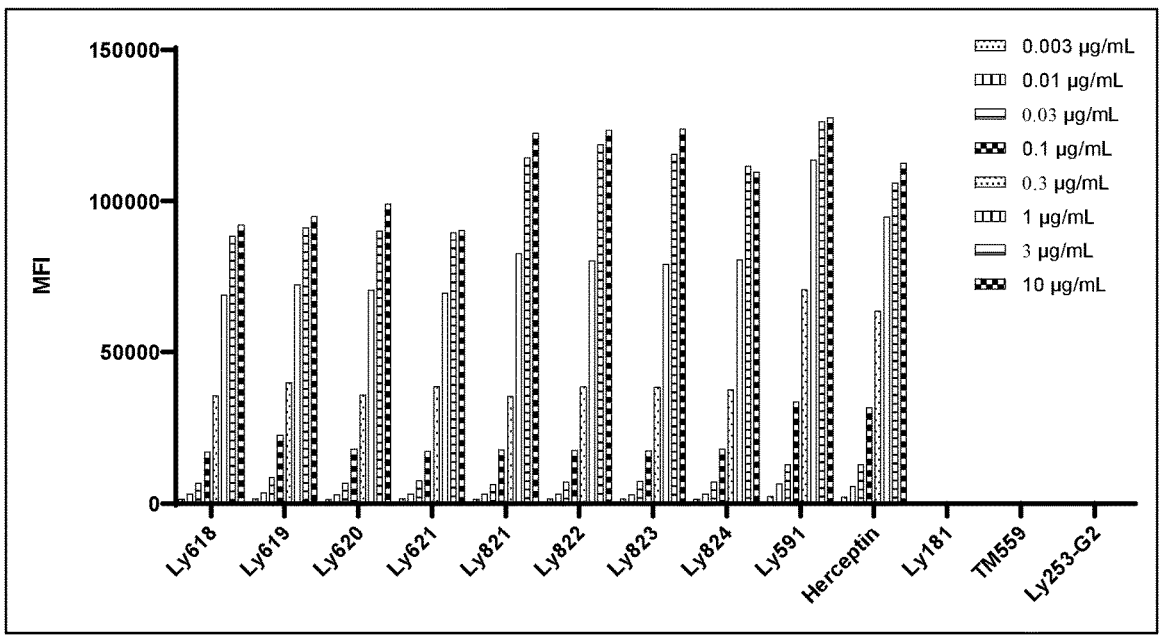
Figure 49C:
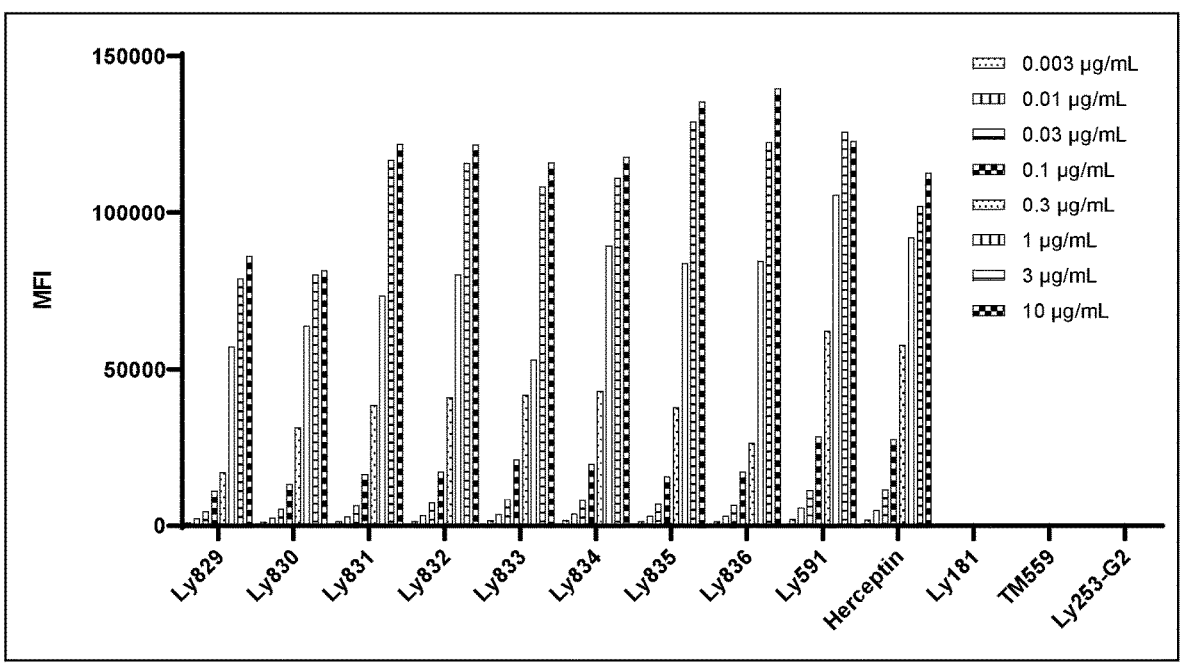

FIGS. 49A-49C are charts showing HER2 binding activity of anti-HER2/CD40 bispecific antibodies as indicated on the x-axis to human HER2 expressed on CHO cells. The bars labeled "IgG control" served as controls. Binding of these anti-HER2/CD40 bispecific antibodies are indicated by the mean fluorescence intensity (MFI) on the y-axis. 49A: Clones Ly622, Ly623, Ly624, Ly625, Ly825, Ly826, Ly827, Ly828, Ly591, Ly181, Herceptin, TM559 and Ly253-G2 at various concentrations as indicated. 49B: Clones Ly618, Ly619, Ly620, Ly621, Ly821, Ly822, Ly823, Ly824, Ly591, Herceptin, Ly181, TM559 and Ly253-G2 at various concentrations as indicated. 49C: Clones Ly829, Ly830, Ly831, Ly832, Ly833, Ly834, Ly835, Ly836, Ly591, Herceptin, Ly181, TM559 and Ly253-G2 at various concentrations as indicated.

Figure 50A:
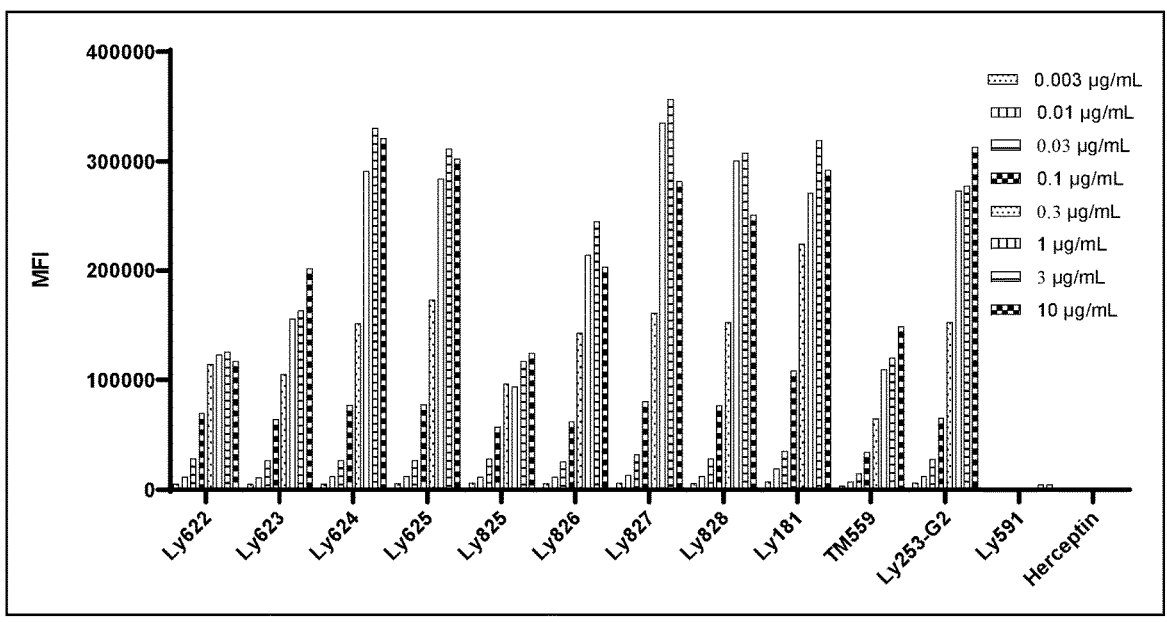
Figure 50B:
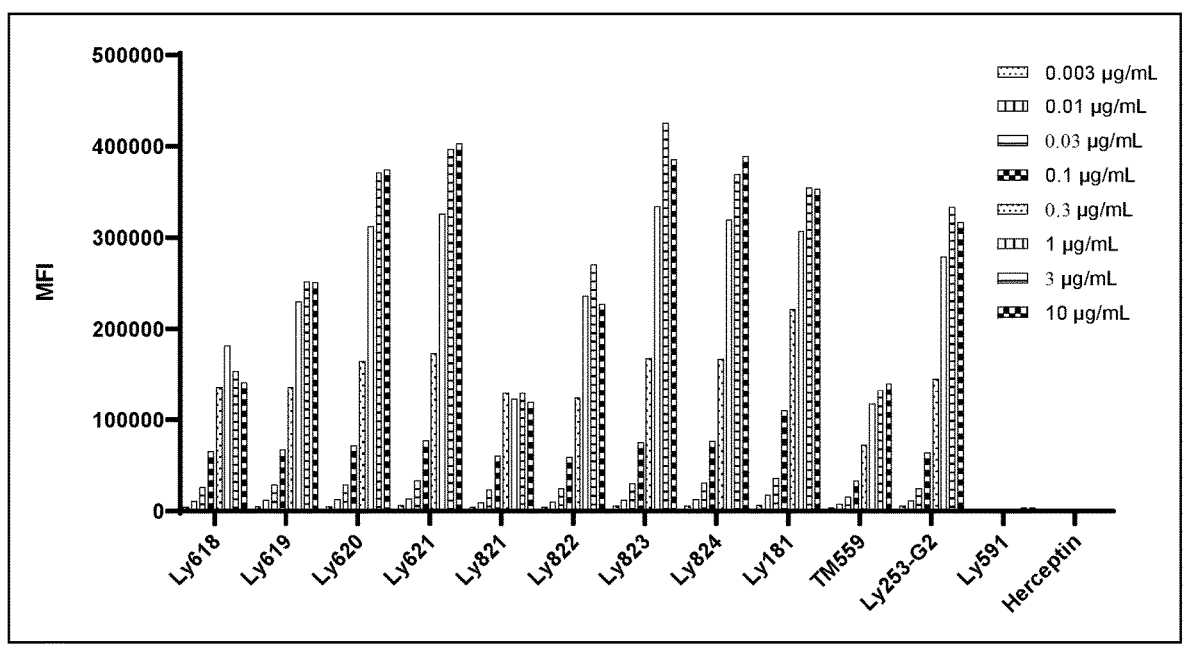
Figure 50C:
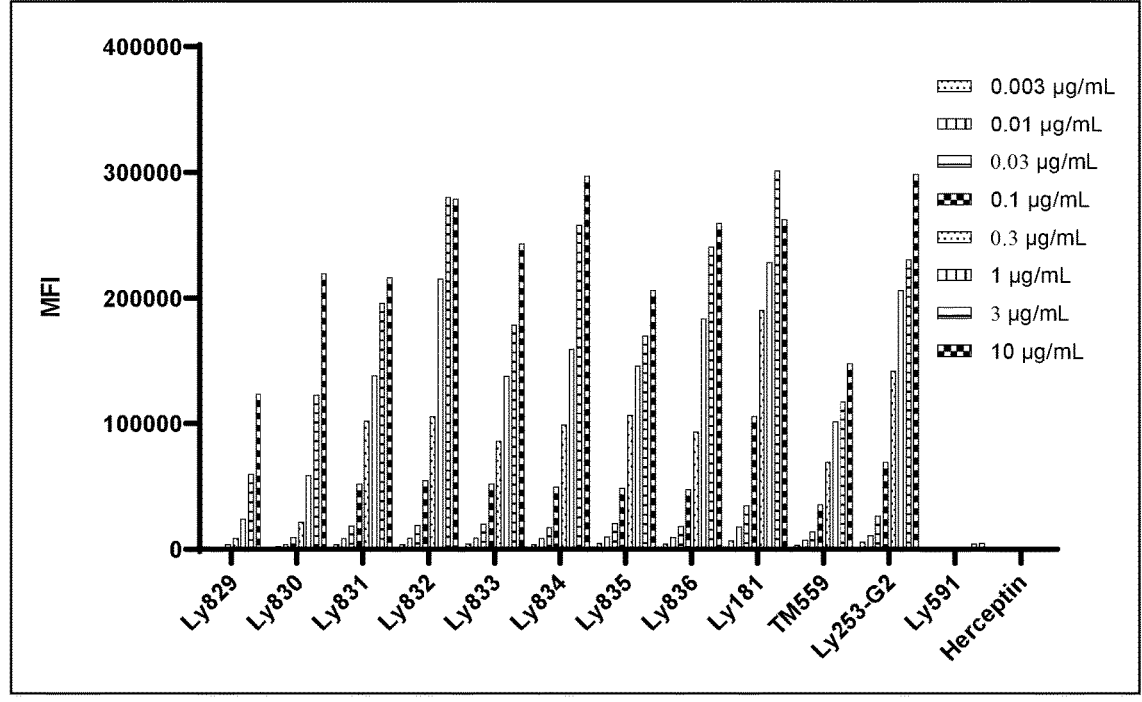

FIGS. 50A-50C are charts showing CD40 binding activity of anti-HER2/CD40 bispecific antibodies as indicated on the x-axis to human CD40 expressed on CHO cells. Ly076 was used as controls. Binding of these anti-HER2/CD40 bispecific antibodies are indicated by the mean fluorescence intensity (MFI) on the y-axis. 50A: Clones Ly622, Ly623, Ly624, Ly625, Ly825, Ly826, Ly827, Ly828, Ly591, Ly181, TM559 and Ly253-G2 at various concentrations as indicated. 50B: Clones Ly618, Ly619, Ly620, Ly621, Ly821, Ly822, Ly823, Ly824, Ly181, TM559, Ly591 and Ly253-G2 at various concentrations as indicated. 50C: Clones Ly829, Ly830, Ly831, Ly832, Ly833, Ly834, Ly835, Ly836, Ly591, Ly181, TM559 and Ly253-G2 at various concentrations as indicated.

Figure 51:
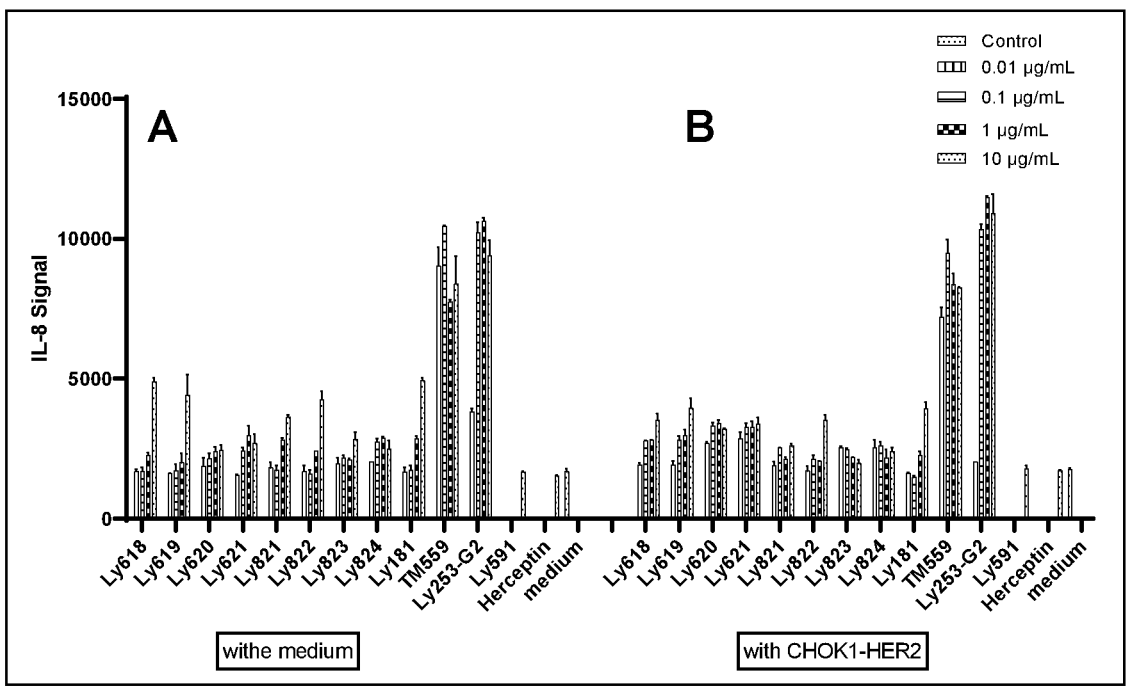
Figure 51:
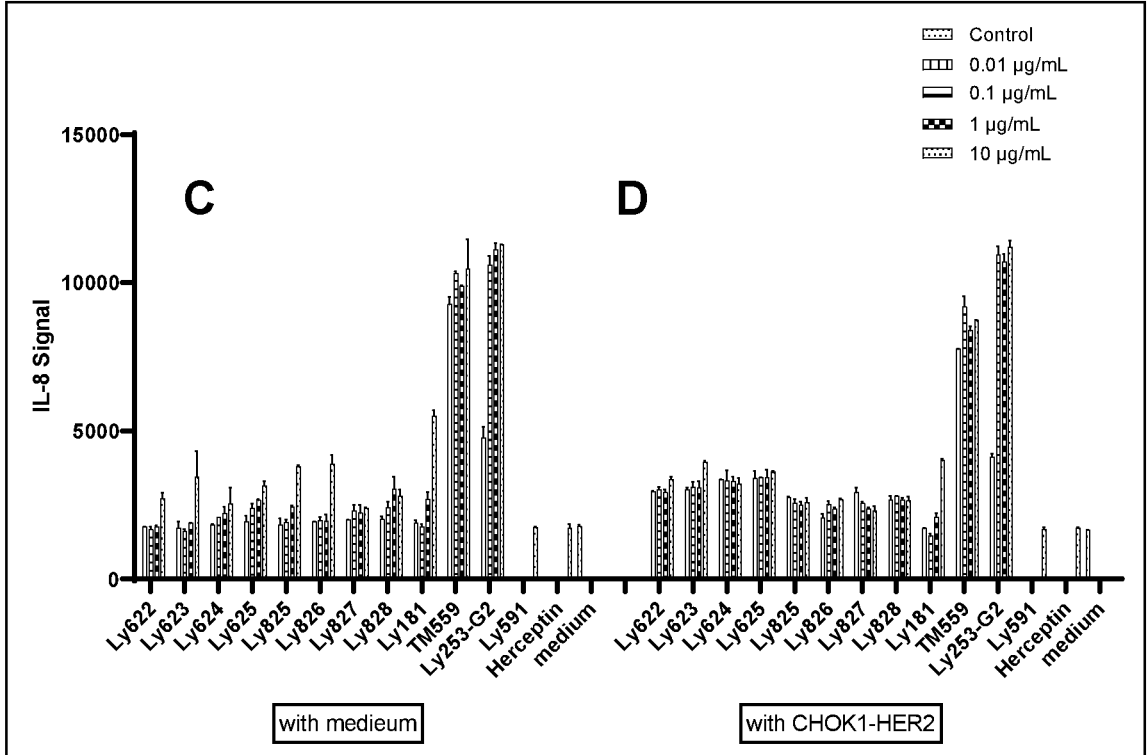
Figure 51:
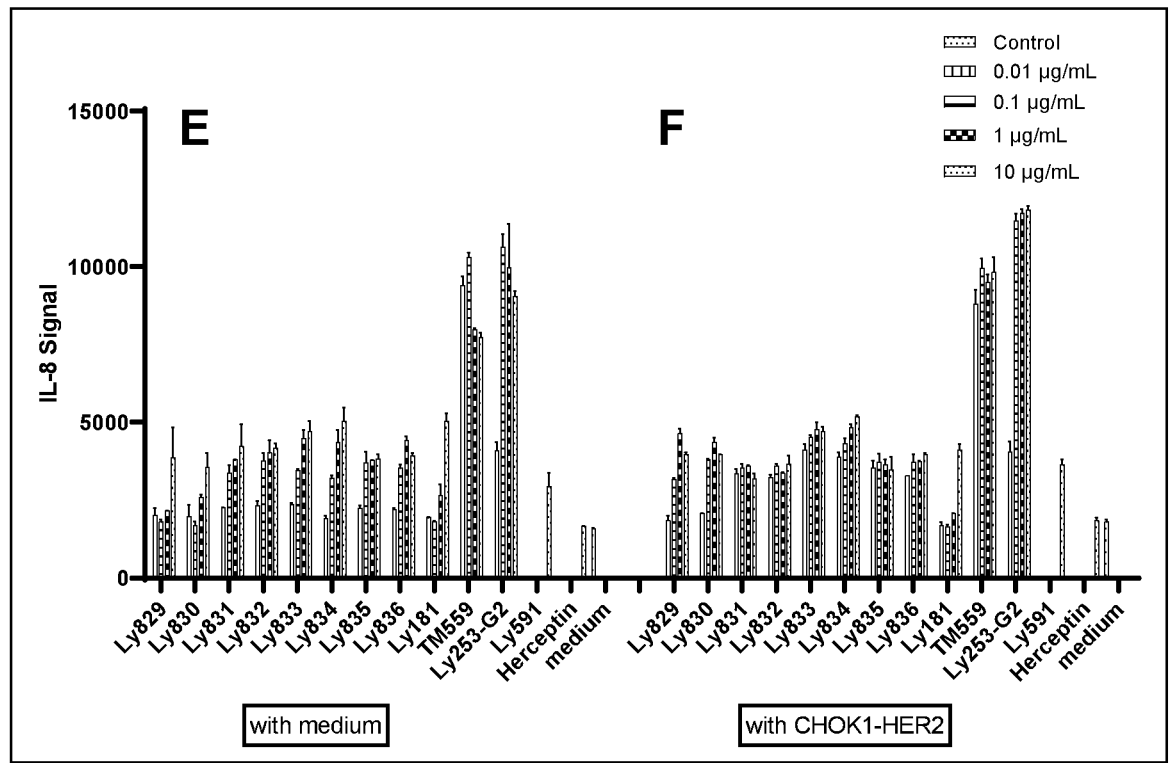

FIG. 51 includes charts showing stimulation of human CD40 activation as indicated by IL8 secretion in a reporter assay by a number of anti-HER2/CD40 antibodies. The agonistic activity of these bispecific antibodies was evaluated either in solution, or co-cultured with HER2 overexpressing CHO cells. The various antibodies are indicated on the x-axis, and the CD40 activation signal are indicated on the y-axis. The bars labeled as "IgG control" and "Mediun" served as controls. Panel A: Clones Ly618, Ly619, Ly620, Ly621, Ly821, Ly822, Ly823, Ly824, Ly181, TM559, Ly591 and Ly253-G2 were in solution at various concentrations as indicated. Panel B: Clones Ly618, Ly619, Ly620, Ly621, Ly821, Ly822, Ly823, Ly824, Ly181, TM559, Ly591 and Ly253-G2 were cocultured with HER2 overexpressing CHO-K1 cells at various concentrations as indicated. Panel C: Clones Ly622, Ly623, Ly624, Ly625, Ly825, Ly826, Ly827, Ly828, Ly591, Ly181, TM559 and Ly253-G2 were in solution at various concentrations as indicated. Panel D: Clones Ly622, Ly623, Ly624, Ly625, Ly825, Ly826, Ly827, Ly828, Ly591, Ly181, TM559 and Ly253-G2 were cocultured with HER2 overexpressing CHO-K1 cells at various concentrations as indicated. Panel E: Clones Ly829, Ly830, Ly831, Ly832, Ly833, Ly834, Ly835, Ly836, Ly591, Ly181, TM559 and Ly253-G2 were in solution at various concentrations as indicated. Panel F: Clones Ly829, Ly830, Ly831, Ly832, Ly833, Ly834, Ly835, Ly836, Ly591, Ly181, TM559 and Ly253-G2 were cocultured with HER2 overexpressing CHO-K1 cells at various concentrations as indicated.

FIGS. 52A-52D are charts showing the activity of a number of anti-HER2/CD40 bispecific antibodies on the proliferation of human B cells from two healthy donors. The various antibodies are indicated on the x-axis, and the proliferation of human B cells are indicated by the signal of luminescence (RLU) on the y-axis.

Figure 53:
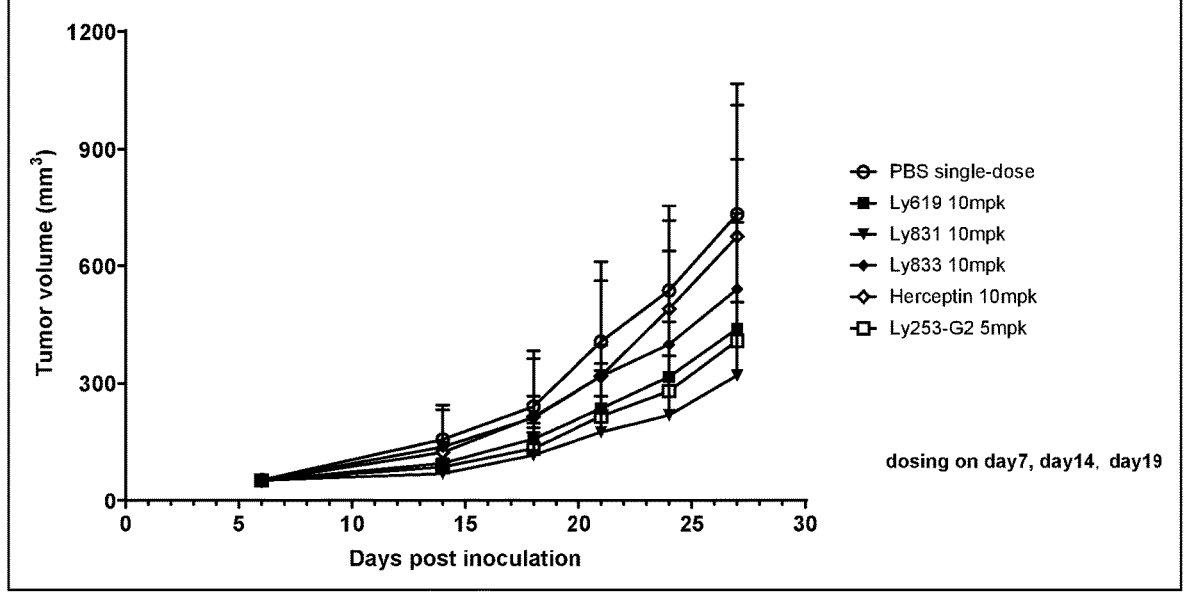

FIG. 53 is a graph showing the anti-tumor activity of anti-HER2/CD40 antibodies in a human CD40 knock-in mouse syngeneic model with human HER2 overexpressing MC38 tumor cells. Anti-tumor effects of exemplary clones Ly619, Ly831 and Ly833 were observed.

DETAILED DESCRIPTION OF THE INVENTION

Provided herein are antibodies specific to CD40 (i.e., anti-CD40 antibodies such as humanized anti-CD40 antibodies), antibodies specific to PD-L1 (i.e., anti-PD-L1 antibodies), antibodies specific to B7H3 (i.e., anti-B7H3 antibodies), or antibodies specific to B7H4 (i.e., anti-B7H4 antibodies). Also provided herein are bi-specific antibodies comprising a first antibody moiety specific to CD40 and a second antigen which may be a tumor antigen. Examples include, but are not limited to, PD-1, PD-L1, B7H3, B7H4, carcinoembryonic antigen (CEA), human epidermal growth factor receptor 2 (HER2), or necrotic tumor cells. Such antibodies or bi-specific antibodies may be used for various therapeutic, diagnostic, or research purposes. For example, the antibodies may be used in modulating immune responses such as anti-tumor immune responses in subjects in need of such treatment. The antibodies may also be used for cancer treatment or cancer diagnosis.

I. Antibody Molecules

As used herein, an antibody (interchangeably used in plural form) refers to an immunoglobulin molecule capable of specific binding to a target, e.g., any of the target antigens disclosed herein, through at least one antigen recognition site, located in the variable region of the immunoglobulin molecule. As used herein, the term "antibody" encompasses not only intact (i.e., full-length) polyclonal or monoclonal antibodies, but also antigen-binding fragments thereof (such as Fab, Fab', F(ab')2, Fv), single chain (scFv), mutants thereof, fusion proteins comprising an antibody portion, humanized antibodies, chimeric antibodies, diabodies, nanobodies, linear antibodies, single chain antibodies, multispecific antibodies (e.g., bispecific antibodies) and any other modified configuration of the immunoglobulin molecule that comprises an antigen recognition site of the required specificity, including glycosylation variants of antibodies, amino acid sequence variants of antibodies, and covalently modified antibodies. An antibody includes an antibody of any class, such as IgD, IgE, IgG, IgA, or IgM (or sub-class thereof), and the antibody need not be of any particular class. Depending on the antibody amino acid sequence of the constant domain of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant domains that correspond to the different classes of immunoglobulins are called alpha, delta, epsilon, gamma, and mu, respectively. The subunit structures and three-dimensional configurations of different classes of immunoglobulins are well known.

A typical antibody molecule comprises a heavy chain variable region ($V_H$) and a light chain variable region ($V_L$), which are usually involved in antigen binding. The $V_H$ and $V_L$ regions can be further subdivided into regions of hypervariability, also known as "complementarity determining regions" ("CDR"), interspersed with regions that are more conserved, which are known as "framework regions" ("FR"). Each $V_H$ and $V_L$ is typically composed of three CDRs and four FRs, arranged from amino-terminus to carboxy-terminus in the following order: FR1, CDR1, FR2, CDR2, FR3, CDR3, FR4. The extent of the framework region and CDRs can be precisely identified using methodology known in the art, for example, by the Kabat definition, the Chothia definition, the AbM definition, and/or the contact definition, all of which are well known in the art. See, e.g., Kabat, E. A., et al. (1991) *Sequences of Proteins of Immunological Interest, Fifth Edition*, U.S. Department of Health and Human Services, NIH Publication No. 91-3242, Chothia et al., (1989) Nature 342:877; Chothia, C. et al. (1987) J. Mol. Biol. 196:901-917, Al-lazikani et al (1997) J.

Molec. Biol. 273:927-948; and Almagro, J. Mol. Recognit. 17:132-143 (2004). See also hgmp.mrc.ac.uk and bioinf.org.uk/abs.

The antibodies described herein can be murine, rat, human, or any other origin (including chimeric or humanized antibodies). Such antibodies are non-naturally occurring, i.e., would not be produced in an animal without human act (e.g., immunizing such an animal with a desired antigen or fragment thereof or isolated from antibody libraries).

Any of the antibodies described herein can be either monoclonal or polyclonal. A "monoclonal antibody" refers to a homogenous antibody population and a "polyclonal antibody" refers to a heterogeneous antibody population. These two terms do not limit the source of an antibody or the manner in which it is made.

(i) Anti-CD40 Antibodies

One aspect of the present disclosure provides humanized anti-CD40 antibodies. CD40 is a protein well known in the art. For example, NCBI GenBank Accession Nos. NP_001241.1 and XP_005569275.1 provide information for the human and cynomolgus monkey CD40 antigens, respectively.

Humanized Antibodies

In some embodiments, the anti-CD40 antibodies disclosed herein are humanized antibodies derived from a non-human parent antibody clone, for example, a murine antibody binding to CD40 such as human CD40. Humanized antibodies refer to forms of non-human (e.g., murine) antibodies that are specific chimeric immunoglobulins, immunoglobulin chains, or antigen-binding fragments thereof that contain minimal sequence derived from non-human immunoglobulin. For the most part, humanized antibodies are human immunoglobulins (recipient antibody) in which residues from a CDR of the recipient are replaced by residues from a CDR of a non-human species (donor antibody) such as mouse, rat, or rabbit having the desired specificity, affinity, and capacity. In some instances, Fv framework region (FR) residues of the human immunoglobulin are replaced by corresponding non-human residues. Furthermore, the humanized antibody may comprise residues that are found neither in the recipient antibody nor in the imported CDR or framework sequences, but are included to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Antibodies may have Fc regions modified as described in WO 99/58572. Other forms of humanized antibodies have one or more CDRs (one, two, three, four, five, or six) which are altered with respect to the original antibody. This is also also termed one or more CDRs "derived from" one or more CDRs from the original antibody. Humanized antibodies may also involve affinity maturation.

Methods for constructing humanized antibodies are also well known in the art. See, e.g., Queen et al., Proc. Natl. Acad. Sci. USA, 86:10029-10033 (1989). In one example, variable regions of $V_H$ and $V_L$ of a parent non-human antibody are subjected to three-dimensional molecular modeling analysis following methods known in the art. Next, framework amino acid residues predicted to be important for the formation of the correct CDR structures are identified using the same molecular modeling analysis. In parallel, human $V_H$ and $V_L$ chains having amino acid sequences that are homologous to those of the parent non-human antibody are identified from any antibody gene database using the parent $V_H$ and $V_L$ sequences as search queries. Human $V_H$ and $V_L$ acceptor genes are then selected.

The CDR regions within the selected human acceptor genes can be replaced with the CDR regions from the parent non-human antibody or functional variants thereof. When necessary, residues within the framework regions of the parent chain that are predicted to be important in interacting with the CDR regions can be used to substitute for the corresponding residues in the human acceptor genes.

In some embodiments, the anti-CD40 antibodies disclosed herein are humanized antibodies derived from murine parent clone Lyv377, which are disclosed in Example 1 below. Such a humanized antibody may comprise a heavy chain framework of IGHV3-73*01 and/or a light chain framework of IGKV1-39*01. In addition, such a humanized antibody may comprise the same heavy chain and/or light chain complementary determining regions (CDRs) as the murine parent clone. Two antibodies having the same $V_H$ and/or $V_L$ CDRs means that their CDRs are identical when determined by the same approach (e.g., the Kabat definition, the Chothia definition, the AbM definition, and/or the contact definition as known in the art). Alternatively, the humanized anti-CD40 antibodies, which may comprise the heavy chain framework of IGHV3-73*01 and/or a light chain framework of IGKV1-39*01, may comprise one or more amino acid residue variations in one or more CDR regions as relative to the corresponding CDR regions of the murine parent Lyv377. For example, the humanized antibody may comprise up to 5 (e.g., up to 4, 3, 2, or 1) amino acid residues in the three heavy chain CDRs collectively. In other examples, the humanized antibody may comprise up to 5 (e.g., up to 4, 3, 2, or 1) amino acid residues in the three light chain CDRs collectively. In yet other examples, the humanized antibody may comprise up to 8 (e.g., up to 7, 6, 5, 4, 3, 2, or 1) amino acid residues in the three heavy chain CDRs and the three light chain CDRs collectively.

In some embodiments, the anti-CD40 antibodies disclosed herein are humanized antibodies derived from murine parent clone Lyv378, which are disclosed in Example 1 below. Such a humanized antibody may comprise a heavy chain framework of IGHV3-23*04 and/or a light chain framework of IGKV1-39*01. In addition, such a humanized antibody may comprise the same heavy chain and/or light chain complementary determining regions (CDRs) as the murine parent clone. Alternatively, the humanized anti-CD40 antibodies, which may comprise the heavy chain framework of IGHV3-23*04 and/or a light chain framework of IGKV1-39*01, may comprise one or more amino acid residue variations in one or more CDR regions as relative to the corresponding CDR regions of the murine parent Lyv378. For example, the humanized antibody may comprise up to 5 (e.g., up to 4, 3, 2, or 1) amino acid residues in the three heavy chain CDRs collectively. In other examples, the humanized antibody may comprise up to 5 (e.g., up to 4, 3, 2, or 1) amino acid residues in the three light chain CDRs collectively. In yet other examples, the humanized antibody may comprise up to 8 (e.g., up to 7, 6, 5, 4, 3, 2, or 1) amino acid residues in the three heavy chain CDRs and the three light chain CDRs collectively.

Alternatively or in addition, the amino acid residue variations can be conservative amino acid residue substitutions. As used herein, a "conservative amino acid substitution" refers to an amino acid substitution that does not alter the relative charge or size characteristics of the protein in which the amino acid substitution is made. Variants can be prepared according to methods for altering polypeptide sequence known to one of ordinary skill in the art such as are found in references which compile such methods, e.g. Molecular Cloning: A Laboratory Manual, J. Sambrook, et al., eds., Second Edition, Cold Spring Harbor Laboratory Press, Cold Spring Harbor, New York, 1989, or Current Protocols in Molecular Biology, F. M. Ausubel, et al., eds., John Wiley & Sons, Inc., New York. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D.

Exemplary heavy chain CDRs and light chain CDRs of the humanized anti-CD40 antibodies disclosed herein are provided in Table 1 below (determined following the Kabat CDR definition):

TABLE 1

CDR regions of Exemplary Humanized
anti-CD40 Antibodies

| | CDR1 | CDR2 | CDR3 |
|---|---|---|---|
| VH | GFNFNDSFMN (SEQ ID NO: 1) | QIRNKNYNYAT YYTESLEG (SEQ ID NO: 5) | YYYDGFADYFDY (SEQ ID NO: 6) |
| | GFNFQDSFMN (SEQ ID NO: 2) | | |
| | GFNFNDAFMN (SEQ ID NO: 3) | | |
| | GFNFNDYFMN (SEQ ID NO: 4) | | |
| VL | KASQNIYIYLN (SEQ ID NO: 7) | NTNNLQT (SEQ ID NO: 8) | LQHSSRRT (SEQ ID NO: 9) |
| VH | GFTFTNYGLH (SEQ ID NO: 16) | SISPSGGVT YYRDSVKG (SEQ ID NO: 17) | PFLGWGGA NWIAH (SEQ ID NO: 18) |
| VL | LASEDISNDLA (SEQ ID NO: 19) | FVDRLLD (SEQ ID NO: 20) | QQSYKYPPT (SEQ ID NO: 21) |

In some embodiments, any of the humanized anti-CD40 antibodies may comprise the same framework as the human acceptor germline VH and/or VL gene. In other embodiments, the framework region of the humanized antibodies may comprise one or more mutations relative to the human acceptor germline VH and/or VL gene. For example, one or more positions in the framework region of the VH and/or VL chain of a humanized antibody may contain one or more back mutations, which refer to changing a residue in the human acceptor germline gene back to the residue at the corresponding position of the murine parent. For example, humanized antibodies derived from murine parent clone Lyv377 may comprise mutations (e.g., back mutations) at one or more of positions E1 (e.g., E1Q), A24 (e.g., A24T), F70 (e.g., F70V), and R100 (e.g., R100S).

In some examples, the humanized anti-CD40 antibodies disclosed herein may comprise any of the heavy chain and light chain CDRs disclosed herein (e.g., any of the CDR combinations provided in Table 1 above). In addition, such a humanized anti-CD40 antibody may comprise a heavy chain framework at least 80% (e.g., at least 85%, 90%, 95% or above) identical to the heavy chain framework region of IGHV3-23*04 or IGHV3-23*04. Alternatively or in addition, the humanized anti-CD40 antibody may comprise a light chain framework at least 80% (e.g., at least 85%, 90%, 95% or above) identical to the light chain framework region of IGKV1-39*01.

The "percent identity" of two amino acid sequences is determined using the algorithm of Karlin and Altschul Proc. Natl. Acad. Sci. USA 87:2264-68, 1990, modified as in Karlin and Altschul Proc. Natl. Acad. Sci. USA 90:5873-77, 1993. Such an algorithm is incorporated into the NBLAST and XBLAST programs (version 2.0) of Altschul, et al. J. Mol. Biol. 215:403-10, 1990. BLAST protein searches can be performed with the XBLAST program, score=50, word-length=3 to obtain amino acid sequences homologous to the protein molecules of the invention. Where gaps exist between two sequences, Gapped BLAST can be utilized as described in Altschul et al., Nucleic Acids Res. 25 (17): 3389-3402, 1997. When utilizing BLAST and Gapped BLAST programs, the default parameters of the respective programs (e.g., XBLAST and NBLAST) can be used.

Exemplary humanized anti-CD40 antibodies derived from Lyv377 or Lyv378 are provided in Example 1 below, which are also within the scope of the present disclosure.

In some embodiments, the anti-CD40 antibody is Ly253 disclosed in Example 1 below or a functional variant derived therefrom. Ly253 may comprise VH and VL chains fused to a human heavy chain constant region and a human light cian constant region, respectively. The human heavy chain constant region may be from an IgG molecule and/or the human light chain constant region may be from a kappa chain. The heacy chain constant domain may be derived from a suitable Ig isoform, for example, a human IgG1, IgG2, or IgG4 molecule. In some embodiments, the constant domain may comprise one or more mutations in the Fc region to enhance or reduce binding affinity and/or binding specificity to an Fc receptor. Examples are provided herein or disclosed in WO/2018/183520 and PCT/US2019/053505 (filed on Sep. 27, 2019), the relevant disclosures of each of which are incorporated by reference for the purpose and subject matter referenced herein. Such a recombinant antibody may further comprise the same light chain variable region of Ly253 fused to a human light chain constant region, for example, a kappa chain constant region. Exemplary anti-CD40 antibodies derived from Ly253 are provided in Example 1 below, which are also within the scope of the present disclosure.

(ii) Anti-PD-L1 Antibodies

The present disclosure also provides antibodies that bind human PD-L1, which may be of any source, for example, human and/or monkey PD-L1. Such anti-PD-L1 antibodies (i.e., antibodies that bind the PD-L1 antigen) may specifically bind PD-L1 of a particular species (e.g., human PD-L1). Alternatively, the anti-PD-L1 antibodies described herein may cross-react with PD-L1 antigens of different species (e.g., binding to both human and monkey PD-L1). In some instances, the anti-PD-L1 antibodies described herein can bind cell surface PD-L1, for example, PD-L1 expressed on cells (e.g., immune cells) that naturally express PD-L1 on the surface. The anti-PD-L1 antibodies described herein may be agonistic antibodies, which, upon binding to PD-L1, elicit cell signaling mediated by PD-L1.

PD-L1 (programmed death-ligand 1), also known as CD274 or B7 homolog 1 (B7-H1), is a 40 kDa transmembrane protein that plays an important role in suppressing the adaptive arm of immune system. PD-L1 is a protein well known in the art. For example, the amino acid sequence information of human PD-L1 can be find under Gene ID: 29126.

In some embodiments, the anti-PD-L1 antibodies described herein bind to the same epitope of a PD-L1 polypeptide as reference antibody Lyv5574 described herein (see Example 3 below) or complete against the reference antibody from binding to the PD-L1 antigen. An "epitope" refers to the site on a target antigen that is recognized and bound by an antibody. The site can be entirely composed of amino acid components, entirely composed of chemical modifications of amino acids of the protein (e.g., glycosyl moieties), or composed of combinations thereof. Overlapping epitopes include at least one common amino acid residue. An epitope can be linear, which is typically 6-15 amino acids in length. Alternatively, the epitope can be conformational. The epitope to which an antibody binds can be determined by routine technology, for example, the epitope mapping method (see, e.g., descriptions below). An antibody that binds the same epitope as a reference antibody described herein may bind to exactly the same epitope or a substantially overlapping epitope (e.g., containing less than 3 non-overlapping amino acid residue, less than 2 non-overlapping amino acid residues, or only 1 non-overlapping amino acid residue) as the reference antibody. Whether two antibodies compete against each other from binding to the cognate antigen can be determined by a competition assay, which is well known in the art.

In some embodiments, the anti-PD-L1 antibody as described herein comprises a heavy chain variable region that comprises a heavy chain CDR1 region (HC CDR1), a heavy chain CDR2 region (HC CDR2), and a heavy chain CDR3 region (HC CDR3) connected by heavy chain framework regions. Alternatively or in addition, the anti-PD-L1 may comprise a light chain variable region that comprises a light chain CDR1 region (LC CDR1), a light chain CDR2 region (LC CDR2), and a light chain CDR3 region (LC CDR3) connected by light chain framework regions. In some examples, the anti-PD-L1 antibody disclosed herein may comprise the same heavy chain CDRs and/or the same light chain CDRs as reference antibody Lyv5574 (see details in Example 3 below).

In specific examples, the heavy chain CDRs 1, 2, and 3 of the anti-PD-L1 antibody may comprise the sequences of GYTFTDFWMS (SEQ ID NO:24), QIYPNTGTTHS-NEKFKG (SEQ ID NO:25), and SYHISTTPNWFAY (SEQ ID NO:26), respectively. The light chain CDRs 1, 2, and 3 of the anti-PD-L1 antibody may comprise the sequences of KASQNVYKKLE (SEQ ID NO:27), HTNILQT (SEQ ID NO:28), and YQWNSGPT (SEQ ID NO:29), respectively.

Also within the scope of the present disclosure are functional variants of reference antibody Lyv5574. Such functional variants are substantially similar to the reference antibody, both structurally and functionally. A functional variant comprises substantially the same $V_H$ and $V_L$ CDRs as the reference antibody. For example, it may comprise only up to 5 (e.g., 4, 3, 2, or 1) amino acid residue variations in the total heavy chain CDR regions of the reference antibody and/or comprise only up to 5 (e.g., 4, 3, 2, or 1) amino acid residue variations in the total light chain CDR regions of the reference antibody. In some examples, the functional variant may comprise up to 8 (e.g., 7, 6, 5, 4, 3, 2, or 1) amino acid residue variations in the total heavy and light chain CDRs relative to those of the reference antibody. Such functional variants may bind the same epitope of PD-L1 with substantially similar affinity (e.g., having a $K_D$ value in the same order). Alternatively or in addition, the amino acid residue variations are conservative amino acid residue substitutions as disclosed herein.

In some embodiments, the anti-PD-L1 antibody may comprise heavy chain CDRs that are at least 80% (e.g., 85%, 90%, 95%, or 98%) sequence identity, individually or collectively, as compared with the $V_H$ CDRs of Lyv5574 described herein. Alternatively or in addition, the anti-PD-L1 antibody may comprise light chain CDRs that are at least 80% (e.g., 85%, 90%, 95%, or 98%) sequence identity, individually or collectively, as compared with the $V_L$ CDRs as Lyv5574.

In some examples, the anti-PD-L1 antibody disclosed herein can be a humanized antibody derived from reference antibody Lyv5574. Such humanized antibodies may comprise a heavy chain framework region from germline gene IGHV1-46*01 and/or a light chain framework region from germline gene IGKV1-27*01. In some instances, the humanized antibody may have the same heavy chain and/or light chain CDRs as Lyv5574. Alternatively, it may comprise substantially similar heavy chain and/or light chain CDRs as Lyv5574, for example, comprising no more than 5 amino acid residue variations (e.g., no more than 4, 3, 2, or 1) in heavy chain and/or light chain CDRs relative to Lyv5574. Alternatively or in addition, the humanized antibody may contain one or more mutations (e.g., one or more back mutations) in the heavy chain and/or light chain framework region as compared with the human acceptor heavy chain and/or light chain framework region. In specific examples, the humanized antibody may comprise one or more back mutations in the VL framework at position L42 (e.g., L42V), F71 (e.g., F71Y), or both. Alternatively or in addition, the humanized antibody may comprise a heavy chain framework region that is at least 80% (e.g., at least 85%, 90%, 95%, or above) identical to the framework region of IGHV1-46*01 and/or comprise a light chin framework region that is at least 80% (e.g., at least 85%, 90%, 95%, or above) identical to the framework region of IGKV1-27*01. Structural information of IGHV1-46*01 and IGKV1-27*01 are provided in Example 3 below.

Exemplary anti-PD-L1 antibodies and humanized versions thereof are provided in Example 3 below, which are also within the scope of the present disclosure.

(ii) Anti-B7H3 Antibodies

The present disclosure also provides antibodies that bind human B7H3, which may be of any source, for example, human and/or monkey B7H3. Such anti-B7H3 antibodies (i.e., antibodies that bind the B7H3 antigen) may specifically bind B7H3 of a particular species (e.g., human B7H3). Alternatively, the anti-B7H3 antibodies described herein may cross-react with B7H3 antigens of different species (e.g., binding to both human and monkey B7H3). In some instances, the anti-B7H3 antibodies described herein can bind cell surface B7H3, for example, B7H3 expressed on cells (e.g., immune cells) that naturally express B7H3 on the surface.

B7H3, also known as CD276, is an immune checkpoint molecule of the B7 and CD28 families. It is reported that B7H3 is aberrantly overly expressed in many type of cancer and its up-regulation usually is indicative of poor clinical prognosis. B7H3 is a protein well known in the art. For example, the structural information of human B7H3 can be find under Gene ID: 80381.

In some embodiments, the anti-B7H3 antibodies described herein bind to the same epitope of a B7H3 polypeptide as reference antibody Lyv383 or reference antibody Lyv387 both of which are disclosed in Example 7 below, or complete against the reference antibody from binding to the B7H3 antigen.

In some embodiments, the anti-B7H3 antibody as described herein comprises a heavy chain variable region that comprises a heavy chain CDR1 region (HC CDR1), a heavy chain CDR2 region (HC CDR2), and a heavy chain CDR3 region (HC CDR3) connected by heavy chain framework regions. Alternatively or in addition, the anti-B7H3 may comprise a light chain variable region that comprises a light chain CDR1 region (LC CDR1), a light chain CDR2 region (LC CDR2), and a light chain CDR3 region (LC CDR3) connected by light chain framework regions. In some examples, the anti-B7H3 antibody disclosed herein may comprise the same heavy chain CDRs and/or the same light chain CDR3 as reference antibody Lyv383 (see details in Example 3 below). In other examples, the anti-B7H3 antibody disclosed herein may comprise the same heavy chain CDRs and/or the same light chain CDR3 as reference antibody Lyv387 (see details in Example 7 below).

In specific examples, the heavy chain CDRs 1, 2, and 3 of the anti-B7H3 antibody may comprise the sequences of GYTFTSYVMH (SEQ ID NO:33), INPYNDG-TECTDKFKG (SEQ ID NO:34), and IYYGYDGTYFGV (SEQ ID NO:35), respectively. The light chain CDRs 1, 2, and 3 of the anti-PD-L1 antibody may comprise the sequences of RASSSVSYMH (SEQ ID NO:39), TSNLAS (SEQ ID NO:40), and QQWSSNTLT (SEQ ID NO: 41), respectively.

In other specific examples, the heavy chain CDRs 1, 2, and 3 of the anti-B7H3 antibody may comprise the sequences of GYTFTSYWMH (SEQ ID NO:36), MIHPNSGGTNYNEKFKG (SEQ ID NO:37), and SQATWFAY (SEQ ID NO:38), respectively. The light chain CDRs 1, 2, and 3 of the anti-PD-L1 antibody may comprise the sequences of RASSSVSSSYLH (SEQ ID NO:42), STSNLAS (SEQ ID NO:43), and QHYSGYPLT (SEQ ID NO:44), respectively.

Also within the scope of the present disclosure are functional variants of reference antibody Lyv383 or Lyv387. Such functional variants are substantially similar to the reference antibody, both structurally and functionally. A functional variant comprises substantially the same $V_H$ and $V_L$ CDRs as the reference antibody. For example, it may comprise only up to 5 (e.g., 4, 3, 2, or 1) amino acid residue variations in the total heavy chain CDR regions of the reference antibody and/or comprise only up to 5 (e.g., 4, 3, 2, or 1) amino acid residue variations in the total light chain CDR regions of the reference antibody. In some examples, the functional variant may comprise up to 8 (e.g., 7, 6, 5, 4, 3, 2, or 1) amino acid residue variations in the total heavy and light chain CDRs relative to those of the reference antibody. Such functional variants may bind the same epitope of B7H3 with substantially similar affinity (e.g., having a $K_D$ value in the same order). Alternatively or in addition, the amino acid residue variations are conservative amino acid residue substitutions as disclosed herein.

In some embodiments, the anti-B7H3 antibody may comprise heavy chain CDRs that are at least 80% (e.g., 85%, 90%, 95%, or 98%) sequence identity, individually or collectively, as compared with the $V_H$ CDRs of Lyv383 described herein. Alternatively or in addition, the anti-B7H3 antibody may comprise light chain CDRs that are at least 80% (e.g., 85%, 90%, 95%, or 98%) sequence identity, individually or collectively, as compared with the $V_L$ CDRs as Lyv383.

In other embodiments, the anti-B7H3 antibody may comprise heavy chain CDRs that are at least 80% (e.g., 85%, 90%, 95%, or 98%) sequence identity, individually or collectively, as compared with the $V_H$ CDRs of Lyv387 described herein. Alternatively or in addition, the anti-B7H3 antibody may comprise light chain CDRs that are at least 80% (e.g., 85%, 90%, 95%, or 98%) sequence identity, individually or collectively, as compared with the $V_L$ CDRs as Lyv387.

Exemplary anti-B7H3 antibodies are provided in Example 7 below, which are also within the scope of the present disclosure.

(iii) Anti-B7H4 Antibodies

The present disclosure also provides antibodies that bind human B7H4, which may be of any source, for example, human and/or monkey B7H4. Such anti-B7H4 antibodies (i.e., antibodies that bind the B7H4 antigen) may specifically bind B7H4 of a particular species (e.g., human B7H4). Alternatively, the anti-B7H4 antibodies described herein may cross-react with B7H4 antigens of different species (e.g., binding to both human and monkey B7H4). In some instances, the anti-B7H4 antibodies described herein can bind cell surface B7H4, for example, B7H4 expressed on cells (e.g., immune cells) that naturally express B7H4 on the surface. B7H4, also known as VCTN1 (V-set domain containing T cell activation inhibitor 1), is a member of the B7 family that negatively regulates T cell immunity. Overexpression of B7H4 has been found to correlate with tumor progression. B7H4 is a protein well known in the art. For example, the structural information of human B7H4 can be find under Gene ID: 79679.

In some embodiments, the anti-B7H4 antibodies described herein bind to the same epitope of a B7H4 polypeptide as reference antibody Lyv361 or reference antibody Lyv366, both of which are disclosed in Example 4 below, or complete against the reference antibody from binding to the B7H4 antigen.

In some embodiments, the anti-B7H4 antibody as described herein comprises a heavy chain variable region that comprises a heavy chain CDR1 region (HC CDR1), a heavy chain CDR2 region (HC CDR2), and a heavy chain CDR3 region (HC CDR3) connected by heavy chain framework regions. Alternatively or in addition, the anti-B7H4 may comprise a light chain variable region that comprises a light chain CDR1 region (LC CDR1), a light chain CDR2 region (LC CDR2), and a light chain CDR3 region (LC CDR3) connected by light chain framework regions. In some examples, the anti-B7H4 antibody disclosed herein may comprise the same heavy chain CDRs and/or the same light chain CDR3 as reference antibody Lyv361 (see details in Example 4 below). In other examples, the anti-B7H4 antibody disclosed herein may comprise the same heavy chain CDRs and/or the same light chain CDR3 as reference antibody Lyv366 (see details in Example 4 below).

In specific examples, the heavy chain CDRs 1, 2, and 3 of the anti-B7H3 antibody may comprise the sequences of GFTFSSYGMS (SEQ ID NO:49), AISTGG-SYTYYPDSVKG (SEQ ID NO:50), and RGATGSWFAY (SEQ ID NO:51), respectively. The light chain CDRs 1, 2, and 3 of the anti-PD-L1 antibody may comprise the sequences of HASQGINNNIG (SEQ ID NO:55), GTNLED (SEQ ID NO:56), and VQYVQFPRT (SEQ ID NO:57), respectively.

In other specific examples, the heavy chain CDRs 1, 2, and 3 of the anti-B7H3 antibody may comprise the sequences of GFTFSDSGMH (SEQ ID NO:52), YIN-SGSSTIYYADSVKG (SEQ ID NO:53), and GRGYAMDY (SEQ ID NO:54), respectively. The light chain CDRs 1, 2, and 3 of the anti-PD-L1 antibody may comprise the sequences of SASSSISSDFLH (SEQ ID NO:58), RISNLAS (SEQ ID NO:59), and QQGSNVPRT (SEQ ID NO:60), respectively.

Also within the scope of the present disclosure are functional variants of reference antibody Lyv361 or Lyv366. Such functional variants are substantially similar to the reference antibody, both structurally and functionally. A functional variant comprises substantially the same $V_H$ and $V_L$ CDRs as the reference antibody. For example, it may comprise only up to 5 (e.g., 4, 3, 2, or 1) amino acid residue variations in the total heavy chain CDR regions of the reference antibody and/or comprises only up to 5 (e.g., 4, 3, 2, or 1) amino acid residue variations in the total light chain CDR regions of the reference antibody. In some examples, the functional variant may comprise up to 8 (e.g., 7, 6, 5, 4, 3, 2, or 1) amino acid residue variations in the total heavy and light chain CDRs relative to those of the reference antibody. Such functional variants may bind the same epitope of B7H4 with substantially similar affinity (e.g., having a $K_D$ value in the same order). Alternatively or in addition, the amino acid residue variations are conservative amino acid residue substitutions as disclosed herein.

In some embodiments, the anti-B7H4 antibody may comprise heavy chain CDRs that are at least 80% (e.g., 85%, 90%, 95%, or 98%) sequence identity, individually or collectively, as compared with the $V_H$ CDRs of Lyv361 described herein. Alternatively or in addition, the anti-B7H4 antibody may comprise light chain CDRs that are at least 80% (e.g., 85%, 90%, 95%, or 98%) sequence identity, individually or collectively, as compared with the $V_L$ CDRs as Lyv361.

In other embodiments, the anti-B7H4 antibody may comprise heavy chain CDRs that are at least 80% (e.g., 85%, 90%, 95%, or 98%) sequence identity, individually or collectively, as compared with the $V_H$ CDRs of Lyv366 described herein. Alternatively or in addition, the anti-B7H4 antibody may comprise light chain CDRs that are at least 80% (e.g., 85%, 90%, 95%, or 98%) sequence identity, individually or collectively, as compared with the $V_L$ CDRs as Lyv366.

In some specific examples, the anti-B7H4 antibodies disclosed herein are chimeric antibodies, for example, chimeric antibodies derived from murine parent clone Lyv361 or from the murine parent clone Lyv366 disclosed in Example 4 below. The chimeric antibodies disclosed herein may comprise the same heavy chain variable domain as that of Lyv361 or that of Lyv366, which can be fused with a constant domain or a fragment thereof from a human immunoglobulin molecule, for example, an IgG molecule, including any suitable isoforms as disclosed herein. In some embodiments, the constant domain may comprise one or more mutations in the Fc region to enhance or reduce binding affinity and/or binding specificity to an Fc receptor. Details are provided elsewhere herein. Such a chimeric antibody may further comprise the same light chain variable region of Lyv361 or of Lyv366 fused to a human light chain constant region, for example, a kappa chain constant region.

Exemplary anti-B7H4 antibodies, including chimeric versions thereof, are provided in Example 4 below, which are also within the scope of the present disclosure.

(iv) Anti-PD-1 Antibodies

In some aspects, the present disclosure also provides antibodies specific to a PD-1 polypeptide, for example, human PD-1. Such an anti-PD-1 antibody may have the same heavy chain variable region ($V_H$) comprising heavy chain complementary determining regions (CDRs) 1, 2, and 3 as reference antibody Ly516, the amino acid sequences of which are provided below. Alternatively or in addition, the anti-PD-1 antibody may have the same light chain variable region ($V_L$) comprising light chain CDRs 1, 2, and 3 as antibody Ly516. In some examples, the anti=PD-1 antibody disclosed herein may comprise the same $V_H$ and/or the same $V_L$ as antibody Ly516.

Any of the anti-PD-1 antibodies may be of any format, such as those disclosed herein. In some embodiments, the antibody is a full-length antibody, for example, an IgG molecule. In some instances, the full-length antibody comprises a heavy chain, which comprises a mutated Fc region having altered binding affinity or specificity to an Fc receptor as relative to its wild-type counterpart.

(v) Bi-Specific Antibodies Specific to CD40 and Another Antigen

In some aspects, the present disclosure also provides bi-specific antibodies each comprising at least two antibody moieties, one specific to CD40 and the other one specific to another antigen of interest, for example, a tumor antigen and/or an immune checkpoint molecule. Examples of the other antigen specific to the bi-specific antibodies disclosed herein include, but are not limited to, PD-1, PD-L1, CEA, HER2, B7H3, or B7H4.

Each antibody portion in the bispecific antibody as described herein can be an antibody in any form, including, but not limited to, intact (i.e., full-length) antibodies, antigen-binding fragments thereof (such as Fab, Fab', F(ab').sub.2, Fv), single chain antibodies (scFv antibodies), and tetravalent antibodies. In some embodiments, the bispecific antibody is tetravalent, which comprises two binding sites for CD40 and two binding sites for the other antigen (e.g., PD-1, PD-L1, CEA, HER2, B7H3, TNT, or B7H4).

Any of the bi-specific antibodies disclosed herein may be in any bi-specific antibody format known in the art, for example, BsIgG, BsAb fragment, Bispecific fusion proteins, or BsAb conjugate. See, e.g., Mol. Immunol. 67 (2): 95-106 (2015).

In some embodiments, a first antibody moiety binding to a first antigen in the bi-specific antibody, e.g., the antibody moiety that binds CD40, can be in a single-chain fragment (scFv) format, and a second antibody moiety binding to a second antigen is in a multi-chain antibody format that comprises a heavy chain comprising a VH and a heavy chain constant region or a portion thereof, and a light chain comprising a VL and a light chain constant region (e.g., a kappa chain). Alternatively, the antibody moiety that binds CD40 may be in the multi-chain antibody format as disclosed herein and the antibody moiety that binds the other antigen can be in an scFv format. Any scFv fragment in a bi-specific antibody may be in VH→VL orientation. Alternatively, it can be in the VL→VH orientation.

In some examples, the bi-specific antibody may comprise two chains: a first chain being a fusion protein of the scFv fragment of one antibody moiety and the heavy chain or the light chain of the other antibody moiety, and the second chain being the other chain of the other antibody moiety. For example, the bi-specific antibody may comprise a first chain that is a fusion protein of a scFv fragment of a first antibody moiety binding to a first antigen (e.g., CD40) fused to the heavy chain of a second antibody moiety, which binds to a second antigen (e.g., PD-1, PD-L1, B7H3, B7H4, CEA, or HER2), and a second chain which is the light chain of the second antibody moiety. In other examples, the bi-specific antibody may comprise a first chain that is a fusion protein of a scFv fragment of a first antibody moiety binding to a first antigen (e.g., CD40) fused to the light chain of a second antibody moiety, which binds to a second antigen (e.g., PD-1, PD-L1, B7H3, B7H4, CEA, or HER2), and a second chain which is the heavy chain of the second antibody moiety. In any of the fusion chains, the scFv fragment and the heavy or light chain may be in any order. In some instances, the scFv can be located at the N-terminus. In other instances, the heavy or light chain may be located at the N-terminus.

A peptide linker may be located between two fragments in a bi-specific antibody disclosed herein, for example, between the VH and VL portions in a scFv fragment, or between the scFv fragment and the heavy or light chain in a fusion chain. Exemplary peptide linker includes the linker of (GGGGS)$_n$. (SEQ ID NOs: 65-70), in which n can be an integer between 1-6, for example, 1, 2, 3, 4, 5, or 6. Any of the peptide linkers described herein, e.g., the SGGGS (SEQ ID NO:65) linker or the (GGGGS)$_4$ (SEQ ID NO:68) linker, can comprise naturally occurring amino acids and/or non-naturally occurring amino acids. Naturally occurring amino acids include alanine (Ala), arginine (Arg), asparagine (Asn), aspartic acid (Asp), cysteine (Cys), glutamic acid (Glu), glutamine (Gin), glycine (Gly), histidine (His), iso-leucine (He), leucine (Leu), lysine (Lys) methionine (Met), ornithine (Orn), phenylalanine (Phe), proline (Pro), serine (Ser), threonine (Thr), tryptophan (Trp), tyrosine (Tyr), and valine (Val). Non-naturally occurring amino acids can include protected amino acids such as naturally occurring amino acids protected with groups such as acetyl, formyl, tosyl, nitro and the like. Non-limiting examples of non-naturally occurring amino acids include azidohomoalanine, homopropargylglycine, homoallylglycine, p-bromophenyl-alanine, p-iodophenylalanine, azidophenylalanine, acetylphenylalanine or ethynylephenylalanine, amino acids containing an internal alkene such as trans-crotylalkene, serine allyl ether, allyl glycine, propargyl glycine, vinyl glycine, pyrrolysine, N-sigma-o-azidobenzyloxycarbonyl-L-Lysine (AzZLys), N-sigma-propargyloxycarbonyl-L-Ly-sine, N-sigma-2-azidoethoxycarbonyl-L-Lysine, N-sigma-tert-butyloxycarbonyl-L-Lysine (BocLys), N-sigma-allyloxycarbonyl-L-Lysine (AlocLys), N-sigma-acetyl-L-Lysine (AcLys), N-sigma-benzyloxycarbonyl-L-Lysine (ZLys), N-sigma-cyclopentyloxycarbonyl-L-Lysine (Cy-cLys), N-sigma-D-prolyl-L-Lysine, N-sigma-nicotinoyl-L-Lysine (NicLys), N-sigma-N-Me-anthraniloyl-L-Lysine (NmaLys), N-sigma-biotinyl-L-Lysine, N-sigma-9-fluore-nylmethoxycarbonyl-L-Lysine, N-sigma-methyl-L-Lysine, N-sigma-dimethyl-L-Lysine, N-sigma-trimethyl-L-Lysine, N-sigma-isopropyl-L-Lysine, N-sigma-dansyl-L-Lysine, N-sigma-o,p-dinitrophenyl-L-Lysine, N-sigma-p-toluene-sulfonyl-L-Lysine, N-sigma-DL-2-amino-2carboxyethyl-L-Lysine, N-sigma-phenylpyruvamide-L-Lysine, N-sigma-pyruvamide-L-Lysine, azidohomoalanine, homopropargylglycine, homoallylglycine, p-bromophenyl-alanine, p-iodophenylalanine, azidophenylalanine, acetylphenylalanine or ethynylephenylalanine, amino acids containing and an internal alkene such as trans-crotylalkene, serine allyl ether, allyl glycine, propargyl glycine, and vinyl glycine.

(a) Anti-CD40 Portion

Any antibody capable of binding to CD40 can be used in constructing the bi-specific antibodies disclosed herein. In some examples, the anti-CD40 portion of the bi-specific antibody described herein may be derived from any of the humanized anti-CD40 antibodies provided herein (e.g., those derived from Lyv377 or Lyv378 disclosed herein). In other examples, the anti-CD40 portion of the bi-specific antibody may be derived from any of the anti-CD40 anti-bodies disclosed herein (e.g., Ly253 or derivatives thereof as disclosed herein).

As used herein, an antibody moiety in a bi-specific antibody "derived from" a parent antibody means that the parent antibody is used as a starting material for making the bi-specific antibody as known in the art. The antibody moiety may comprise the same heavy chain and/or light chain CDRs as those of the parent antibody. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In specific examples, Lyv377 or humanized antibodies derived therefrom (e.g., TM550, TM553, LP3771, LP3772, LP3773, TM738, TM739, TM740, or Ly181) may be used as a starting material for making any of the bi-specific anti-bodies disclosed herein. In other examples, Lyv378 or humanized antibodies derived therefrom (e.g., TM559, LP3781, LP3782, or LP3783) can be used as a starting material for making any of the bi-specific antibodies dis-closed herein. In yet other examples, the Ly253 antibodies disclosed herein may be used as a starting material for making any of the bi-specific antibodies disclosed herein.

(b) Second Antibody Portion in Bi-Specific Antibodies

In addition to the first antibody moiety binding to CD40, the bi-specific antibodies disclosed herein comprise a second antibody moiety capable of binding to a suitable antigen, such as a tumor antigen or an immune checkpoint molecule (e.g., those that negatively regulates immune responses). Examples include B7H3, B7H4, CEA, HER2, PD-1, TNT, or PD-L1.

Anti-CD40/B7H3 Bi-Specific Antibodies

In some embodiments, the second antibody moiety in the bi-specific antibodies disclosed herein binds B7H3, for example, human B7H3. Any antibody capable of binding to B7H3 can be used in constructing the bi-specific antibodies disclosed herein. In some examples, the anti-B7H3 portion of the bi-specific antibody described herein may be derived from any of the anti-B7H3 antibodies provided herein (e.g., Ly383 or Ly387). The anti-B7H3 antibody moiety may comprise the same heavy chain and/or light chain CDRs as a parent antibody, e.g., Ly383 or Ly387. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-B7H3 antibody moi-ety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/B7H3 bi-specific anti-bodies may comprise an anti-CD40 moiety in scFv format and an anti-B7H3 moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-B7H3 antibody such as that of Ly383 or Ly387, and a second chain that is the light chain of the anti-B7H3 antibody. Alternatively, the bi-specific antibody may comprise a first chain comprising the scFv fragment may be fused with the heavy chain of the anti-B7H3 antibody such as that of Ly383 or Ly387, and a second chain that is the heavy chain of the anti-B7H3 antibody. In some instances, the heavy chain of the anti-B7H3 antibody may comprise a mutated Fc region having altered binding affinity and/or binding specificity to an Fc receptor such as those described herein.

Exemplary anti-CD40/B7H3 bi-specific antibodies are provided in Example 7, which are within the scope of the present disclosure.

Anti-CD40/B7H4 Bi-Specific Antibodies

In some embodiments, the second antibody moiety in the bi-specific antibodies disclosed herein binds B7H4, for example, human B7H4. Any antibody capable of binding to B7H4 can be used in constructing the bi-specific antibodies disclosed herein. In some examples, the anti-B7H4 portion of the bi-specific antibody described herein may be derived from any of the anti-B7H4 antibodies provided herein (e.g., Ly361 or Ly366). The anti-B7H3 antibody moiety may comprise the same heavy chain and/or light chain CDRs as a parent antibody, e.g., Ly361 or Ly366. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-B7H4 antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/B7H4 bi-specific antibodies may comprise an anti-CD40 moiety in scFv format and an anti-B7H3 moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-B7H4 antibody such as that of Ly361 or Ly366, and a second chain that is the light chain of the anti-B7H4 antibody. Alternatively, the bi-specific antibody may comprise a first chain comprising the scFv fragment may be fused with the heavy chain of the anti-B7H4 antibody such as that of Ly361 or Ly366, and a second chain that is the heavy chain of the anti-B7H4 antibody. In some instances, the heavy chain of the anti-B7H4 antibody may comprise a mutated Fc region having altered binding affinity and/or binding specificity to an Fc receptor such as those described herein.

Exemplary anti-CD40/B7H4 bi-specific antibodies are provided in Example 4, which are within the scope of the present disclosure.

Anti-CD40/CEA Bi-Specific Antibodies

In some embodiments, the second antibody moiety in the bi-specific antibodies disclosed herein binds CEA, which is an antigen associated with cancer development. Any antibody capable of binding to CEA can be used in constructing the bi-specific antibodies disclosed herein. In some examples, the anti-CEA portion of the bi-specific antibody described herein may be derived from any of the anti-CEA antibodies provided herein (e.g., Ly311 or Ly312). The anti-CEA antibody moiety may comprise the same heavy chain and/or light chain CDRs as a parent antibody, e.g., Ly311 or Ly312. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-CEA antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/CEA bi-specific antibodies may comprise an anti-CD40 moiety in scFv format and an anti-CEA moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-CEA antibody such as that of Ly311 or Ly312, and a second chain that is the light chain of the anti-CEA antibody. Alternatively, the bi-specific antibody may comprise a first chain comprising the scFv fragment may be fused with the heavy chain of the anti-CEA antibody such as that of Ly311 or Ly312, and a second chain that is the heavy chain of the anti-CEA antibody. In some instances, the heavy chain of the anti-CEA antibody may comprise a mutated Fc region having altered binding affinity and/or binding specificity to an Fc receptor such as those described herein.

Exemplary anti-CD40/CEA bi-specific antibodies are provided in Example 5, which are within the scope of the present disclosure.

Anti-CD40/HER2 Bi-Specific Antibodies

In some embodiments, the second antibody moiety in the bi-specific antibodies disclosed herein binds HER2, which is an important biomarker and treatment target for breast cancer. Any antibody capable of binding to HER2 can be used in constructing the bi-specific antibodies disclosed herein. In some examples, the anti-HER2 portion of the bi-specific antibody described herein may be derived from any of the anti-HER2 antibodies provided herein (e.g., TM737 or Ly591). The anti-HER2 antibody moiety may comprise the same heavy chain and/or light chain CDRs as a parent antibody, e.g., TM737 or Ly591. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-HER2 antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/HER2 bi-specific antibodies may comprise an anti-CD40 moiety in scFv format and an anti-HER2 moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-HER2 antibody such as that of TM737 or Ly591, and a second chain that is the light chain of the anti-HER2 antibody. Alternatively, the bi-specific antibody may comprise a first chain comprising the scFv fragment may be fused with the heavy chain of the anti-HER2 antibody such as that of TM737 or Ly591, and a second chain that is the heavy chain of the anti-HER2 antibody. In some instances, the heavy chain of the anti-HER2 antibody may comprise a mutated Fc region having altered binding affinity and/or binding specificity to an Fc receptor such as those described herein.

Exemplary anti-CD40/HER2 bi-specific antibodies are provided in Example 9, which are within the scope of the present disclosure.

Anti-CD40/PD-1 Bi-Specific Antibodies

In some embodiments, the second antibody moiety in the bi-specific antibodies disclosed herein binds PD-1 (programmed cell death protein 1 or CD279), which is an immune checkpoint molecule expressed on the surface of many immune cells that down-regulates immune responses. Any antibody capable of binding to PD-1 can be used in constructing the bi-specific antibodies disclosed herein. Examples include cemiplimab, nivolumab, and pembrolizumab. Anti-PD-1 antibodies disclosed in WO 2017/087599 are also within the scope of the present disclosure and have been incorporated by reference for the purpose and subject matter referenced herein. In some examples, the anti-PD-1 portion of the bi-specific antibody described herein may be derived from any of the anti-PD-1 antibodies provided herein (e.g., Ly516). The anti-PD-1 antibody moiety may comprise the same heavy chain and/or light chain CDRs as a parent antibody, e.g., Ly516. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-PD-1 antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/PD-1 bi-specific antibodies may comprise an anti-CD40 moiety in scFv format and an anti-PD-1 moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-PD-1 antibody such as that of Ly516, and a second chain that is the light chain of the anti-PD-1 antibody. Alternatively, the bi-specific antibody may comprise a first chain comprising the scFv fragment may be fused with the heavy chain of the anti-PD-1 antibody such as that of Ly516, and a second chain that is the heavy chain of the anti-PD-1 antibody. In some instances, the heavy chain of the anti-PD-1 antibody may comprise a mutated Fc region having altered binding affinity and/or binding specificity to an Fc receptor such as those described herein.

Exemplary anti-CD40/PD-1 bi-specific antibodies are provided in Example 8, which are within the scope of the present disclosure.

Anti-CD40/TNT Bi-Specific Antibodies

In some embodiments, the second antibody moiety in the bi-specific antibodies disclosed herein binds necrotic tumor cells (TNT). Any antibody capable of binding to necrotic tumor cells can be used in constructing the bi-specific antibodies disclosed herein. In some examples, the anti-TNT portion of the bi-specific antibody described herein may be derived from any of the anti-TNT antibodies provided herein (e.g., Ly368). The anti-TNT antibody moiety may comprise the same heavy chain and/or light chain CDRs as a parent antibody, e.g., Ly368. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-HER2 antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/TNT bi-specific antibodies may comprise an anti-CD40 moiety in scFv format and an anti-TNT moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-TNT antibody such as that of Ly368, and a second chain that is the light chain of the anti-TNT antibody. Alternatively, the bi-specific antibody may comprise a first chain comprising the scFv fragment may be fused with the heavy chain of the anti-TNT antibody such as that of Ly368, and a second chain that is the heavy chain of the anti-TNT antibody. In some instances, the heavy chain of the anti-TNT antibody may comprise a mutated Fc region having altered binding affinity and/or binding specificity to an Fc receptor such as those described herein.

Exemplary anti-CD40/TNT bi-specific antibodies are provided in Example 6, which are within the scope of the present disclosure.

Anti-CD40/PD-L1 Bi-Specific Antibodies

In some embodiments, the second antibody moiety in the bi-specific antibodies disclosed herein binds PD-L1 (see above discussions). Any antibody capable of binding to PD-L1 can be used in constructing the bi-specific antibodies disclosed herein. Examples include avelumab, durvalumab, and atezolizumab. In some examples, the anti-PD-L1 portion of the bi-specific antibody described herein may be derived from any of the anti-PD-1 antibodies provided herein (e.g., Ly074, Ly075, or Ly076). The anti-PD-L1 antibody moiety may comprise the same heavy chain and/or light chain CDRs as a parent antibody, e.g., Ly074, Ly075, or Ly076. Alternatively, the antibody moiety may comprise substantially similar heavy chain and/or light chain CDRs as those of the parent antibody (e.g., comprising no more than 5, 4, 3, 2, or 1 amino acid residue variations as compared with the parent antibody). In some instances, the anti-PD-L1 antibody moiety in the bi-specific antibody may have the same heavy chain variable region and/or the same light chain variable region as the parent antibody. For example, the antibody moiety in the bi-specific antibody may have the same heavy chain and/or the same light chain as the parent antibody.

In some examples, the anti-CD40/PD-L1 bi-specific antibodies may comprise an anti-CD40 moiety in scFv format and an anti-PD-L1 moiety in multi-chain format. The anti-CD40 scFv fragment may be derived from any of the anti-CD40 antibodies disclosed herein, for example, Lyv377, Lyv378, or Ly253. For example, the bi-specific antibody may comprise a first chain comprising the scFv fragment fused with the heavy chain of the anti-PD-L1 antibody such as that of Ly074, Ly075, or Ly076, and a second chain that is the light chain of the anti-PD-L1 antibody. Alternatively, the bi-specific antibody may comprise a first chain comprising the scFv fragment may be fused with the heavy chain of the anti-PD-L1 antibody such as that of Ly074, Ly075, or Ly076, and a second chain that is the heavy chain of the anti-PD-L1 antibody. In some instances, the heavy chain of the anti-PD-L1 antibody may comprise a mutated Fc region having altered binding affinity and/or binding specificity to an Fc receptor such as those described herein.

Exemplary anti-CD40/PD-L1 bi-specific antibodies are provided in Example 3, which are within the scope of the present disclosure.

Any of the antibodies specific to CD40, PD-L1, B7H3, or B7H4 described herein may be a full-length antibody, which contains two heavy chains and two light chains, each including a variable domain and a constant domain. Alternatively, the heavy chain constant region of the antibodies described herein may comprise a single domain (e.g., CH1, CH2, or CH3) or a combination of any of the single domains. Antibody heavy and light chain constant regions are well known in the art, e.g., those provided in the IMGT database (www.imgt.org) or at www.vbase2.org/vbstat.php., both of which are incorporated by reference herein.

Alternatively, the antibodies disclosed herein can be an antigen-binding fragment of a full-length antibody. Examples of binding fragments encompassed within the term "antigen-binding fragment" of a full length antibody include (i) a Fab fragment, a monovalent fragment consisting of the $V_L$, $V_H$, $C_L$ and $C_H1$ domains; (ii) a F(ab')$_2$ fragment, a bivalent fragment including two Fab fragments linked by a disulfide bridge at the hinge region; (iii) a Fd fragment consisting of the $V_H$ and $C_H1$ domains; (iv) a Fv fragment consisting of the $V_L$ and $V_H$ domains of a single arm of an antibody, (v) a dAb fragment (Ward et al., (1989) *Nature* 341:544-546), which consists of a $V_H$ domain; and (vi) an isolated complementarity determining region (CDR) that retains functionality. Furthermore, although the two domains of the Fv fragment, $V_L$ and $V_H$, are coded for by separate genes, they can be joined using recombinant methods, by a synthetic linker that enables them to be made as a single protein chain in which the $V_L$ and $V_H$ regions pair to form monovalent molecules known as single chain Fv (scFv). See e.g., Bird et al. (1988) *Science* 242:423-426; and Huston et al. (1988) *Proc. Natl. Acad. Sci. USA* 85:5879-5883.

In some embodiments, the antibodies described herein specifically bind to the corresponding target antigen(s) (e.g., CD40, PD-L1, PD-1, CEA, B7H3, B7H4, TNT, or HER2) or an epitope thereof. An antibody that "specifically binds" to an antigen or an epitope is a term well understood in the art. A molecule is said to exhibit "specific binding" if it reacts more frequently, more rapidly, with greater duration and/or with greater affinity with a particular target antigen than it does with alternative targets. An antibody "specifically binds" to a target antigen or epitope if it binds with greater affinity, avidity, more readily, and/or with greater duration than it binds to other substances. For example, an antibody that specifically (or preferentially) binds to an antigen (e.g., those listed above) or an antigenic epitope therein is an antibody that binds this target antigen with greater affinity, avidity, more readily, and/or with greater duration than it binds to other antigens or other epitopes in the same antigen. It is also understood with this definition that, for example, an antibody that specifically binds to a first target antigen may or may not specifically or preferentially bind to a second target antigen. As such, "specific binding" or "preferential binding" does not necessarily require (although it can include) exclusive binding. In some examples, an antibody that "specifically binds" to a target antigen or an epitope thereof may not bind to other antigens or other epitopes in the same antigen (i.e., only baseline binding activity can be detected in a conventional method). Alternatively, or in addition, the antibodies described herein may specifically binds the human antigen or a fragment thereof as relative to the monkey counterpart, or vice versa (e.g., having a binding affinity at least 10-fold higher to one antigen than the other as determined in the same assay under the same assay conditions). In other instances, the antibodies described herein may cross-react to human and a non-human antigen (e.g., monkey), e.g., the difference in binding affinity to the human and the non-human antigen is less than 5-fold, e.g., less than 2-fold, or substantially similar.

In some embodiments, an antibody as described herein has a suitable binding affinity for the target antigen(s) (e.g., CD40, PD-L1, PD-1, CEA, B7H3, B7H4, TNT, or HER2) or antigenic epitopes thereof. As used herein, "binding affinity" refers to the apparent association constant or $K_A$. The $K_A$ is the reciprocal of the dissociation constant ($K_D$). The antibody described herein may have a binding affinity ($K_D$) of at least $10^{-5}$, $10^{-6}$, $10^{-7}$, $10^{-8}$, $10^{-9}$, $10^{-10}$ M, or lower for the target antigen or antigenic epitope. An increased binding affinity corresponds to a decreased $K_D$. Higher affinity binding of an antibody for a first antigen relative to a second antigen can be indicated by a higher $K_A$ (or a smaller numerical value $K_D$) for binding the first antigen than the $K_A$ (or numerical value $K_D$) for binding the second antigen. In such cases, the antibody has specificity for the first antigen (e.g., a first protein in a first conformation or mimic thereof) relative to the second antigen (e.g., the same first protein in a second conformation or mimic thereof; or a second protein). Differences in binding affinity (e.g., for specificity or other comparisons) can be at least 1.5, 2, 3, 4, 5, 10, 15, 20, 37.5, 50, 70, 80, 91, 100, 500, 1000, 10,000 or 105 fold. In some embodiments, any of the antibodies may be further affinity matured to increase the binding affinity of the antibody to the target antigen or antigenic epitope thereof.

Binding affinity (or binding specificity) can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in HBS-P buffer (10 mM HEPES pH7.4, 150 mM NaCl, 0.005% (v/v) Surfactant P20). These techniques can be used to measure the concentration of bound binding protein as a function of target protein concentration. The concentration of bound binding protein ([Bound]) is generally related to the concentration of free target protein ([Free]) by the following equation:

$$[Bound]=[Free]/(Kd+[Free])$$

It is not always necessary to make an exact determination of $K_A$, though, since sometimes it is sufficient to obtain a quantitative measurement of affinity, e.g., determined using a method such as ELISA or FACS analysis, is proportional to $K_A$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

In some embodiments, any of the antibodies (including bi-specific antibodies) capable of binding to CD40, PD-1, PD-L1, B7H3, B7H4, CEA, TNT, and/or HER2 may contain a mutated Fc region as compared with a wild-type counterpart such that the antibody has an altered binding affinity and/or binding specificity to an Fc receptor. In some examples, the antibody may comprise a modified Fc region having an elevated binding affinity to FcγRIIB (CD32B), which may engage FcγRIIB-expressing cells efficiently, or a modified Fc region having low or no binding to all Fcγ receptors, thereby enhancing therapeutic effects. Examples of mutated Fc regions are provided herein or disclosed in WO/2018/183520 and PCT/US2019/053505 (filed on Sep. 27, 2019), the relevant disclosures of each of which are incorporated by reference for the purpose and subject matter referenced herein.

Alternatively, the antibodies described herein may comprise a modified constant region. For example, it may comprise a modified constant region that is immunologically inert, e.g., does not trigger complement mediated lysis, or does not stimulate antibody-dependent cell mediated cytotoxicity (ADCC). ADCC activity can be assessed using methods disclosed in U.S. Pat. No. 5,500,362. In other embodiments, the constant region is modified as described in Eur. J. Immunol. (1999) 29:2613-2624; PCT Application No. PCT/GB99/01441; and/or UK Patent Application No. 9809951.8.

II. Methods For Antibody Preparation

Any of the antibodies, including bi-specific antibodies, as described herein can be made by any method known in the art. See, for example, Harlow and Lane, (1998) Antibodies: A Laboratory Manual, Cold Spring Harbor Laboratory, New York. Antigen-binding fragments of an intact antibody (full-length antibody) can be prepared via routine methods. For example, F(ab')2 fragments can be produced by pepsin digestion of an antibody molecule, and Fab fragments that can be generated by reducing the disulfide bridges of F(ab')2 fragments.

Genetically engineered antibodies, such as humanized antibodies, chimeric antibodies, single-chain antibodies, and bi-specific antibodies, can be produced via, e.g., conventional recombinant technology. In one example, DNA encoding a monoclonal antibodies specific to a target antigen can be readily isolated and sequenced using conventional procedures (e.g., by using oligonucleotide probes that are capable of binding specifically to genes encoding the heavy and light chains of the monoclonal antibodies).

The hybridoma cells serve as a preferred source of such DNA. Once isolated, the DNA may be placed into one or more expression vectors, which are then transfected into host cells such as *E. coli* cells, simian COS cells, Chinese hamster ovary (CHO) cells, or myeloma cells that do not otherwise produce immunoglobulin protein, to obtain the synthesis of monoclonal antibodies in the recombinant host cells. See, e.g., PCT Publication No. WO 87/04462. The DNA can then be modified, for example, by substituting the coding sequence for human heavy and light chain constant domains in place of the homologous murine sequences, Morrison et al., (1984) Proc. Nat. Acad. Sci. 81:6851, or by covalently joining to the immunoglobulin coding sequence all or part of the coding sequence for a non-immunoglobulin polypeptide. In that manner, genetically engineered antibodies, such as "chimeric" or "hybrid" antibodies; can be prepared that have the binding specificity of a target antigen.

Techniques developed for the production of "chimeric antibodies" are well known in the art. See, e.g., Morrison et al. (1984) Proc. Natl. Acad. Sci. USA 81, 6851; Neuberger et al. (1984) Nature 312, 604; and Takeda et al. (1984) Nature 314:452.

Methods for constructing humanized antibodies are also well known in the art. See, e.g., Queen et al., Proc. Natl. Acad. Sci. USA, 86:10029-10033 (1989). In one example, variable regions of VH and VL of a parent non-human antibody are subjected to three-dimensional molecular modeling analysis following methods known in the art. Next, framework amino acid residues predicted to be important for the formation of the correct CDR structures are identified using the same molecular modeling analysis. In parallel, human VH and VL chains having amino acid sequences that are homologous to those of the parent non-human antibody are identified from any antibody gene database using the parent VH and VL sequences as search queries. Human VH and VL acceptor genes are then selected.

The CDR regions within the selected human acceptor genes can be replaced with the CDR regions from the parent non-human antibody or functional variants thereof. When necessary, residues within the framework regions of the parent chain that are predicted to be important in interacting with the CDR regions (see above description) can be used to substitute for the corresponding residues in the human acceptor genes.

A single-chain antibody can be prepared via recombinant technology by linking a nucleotide sequence coding for a heavy chain variable region and a nucleotide sequence coding for a light chain variable region. Preferably, a flexible linker is incorporated between the two variable regions. Alternatively, techniques described for the production of single chain antibodies (U.S. Pat. Nos. 4,946,778 and 4,704, 692) can be adapted to produce a phage or yeast scFv library and scFv clones specific to a target antigen as disclosed herein can be identified from the library following routine procedures.

In some examples, any of the antibodies, including bi-specific antibodies as disclosed herein can be prepared by recombinant technology as exemplified below.

Nucleic acids encoding the heavy and light chain of the antibody as described herein can be cloned into one expression vector, each nucleotide sequence being in operable linkage to a suitable promoter. In one example, each of the nucleotide sequences encoding the heavy chain and light chain is in operable linkage to a distinct prompter. Alternatively, the nucleotide sequences encoding the heavy chain and the light chain can be in operable linkage with a single promoter, such that both heavy and light chains are expressed from the same promoter. When necessary, an internal ribosomal entry site (IRES) can be inserted between the heavy chain and light chain encoding sequences.

In some examples, the nucleotide sequences encoding the two chains of the antibody are cloned into two vectors, which can be introduced into the same or different cells. When the two chains are expressed in different cells, each of them can be isolated from the host cells expressing such and the isolated heavy chains and light chains can be mixed and incubated under suitable conditions allowing for the formation of the antibody.

Generally, a nucleic acid sequence encoding one or all chains of an antibody can be cloned into a suitable expression vector in operable linkage with a suitable promoter using methods known in the art. For example, the nucleotide sequence and vector can be contacted, under suitable conditions, with a restriction enzyme to create complementary ends on each molecule that can pair with each other and be joined together with a ligase. Alternatively, synthetic nucleic acid linkers can be ligated to the termini of a gene. These synthetic linkers contain nucleic acid sequences that correspond to a particular restriction site in the vector. The selection of expression vectors/promoter would depend on the type of host cells for use in producing the antibodies.

A variety of promoters can be used for expression of the antibodies described herein, including, but not limited to, cytomegalovirus (CMV) intermediate early promoter, a viral LTR such as the Rous sarcoma virus LTR, HIV-LTR, HTLV-1 LTR, the simian virus 40 (SV40) early promoter, *E. coli* lac UV5 promoter, and the herpes simplex tk virus promoter.

Regulatable promoters can also be used. Such regulatable promoters include those using the lac repressor from *E. coli* as a transcription modulator to regulate transcription from lac operator-bearing mammalian cell promoters (Brown, M. et al., Cell, 49:603-612 (1987)), those using the tetracycline repressor (tetR) (Gossen, M., and Bujard, H., Proc. Natl. Acad. Sci. USA 89:5547-5551 (1992); Yao, F. et al., Human Gene Therapy, 9:1939-1950 (1998); Shockelt, P., et al., Proc. Natl. Acad. Sci. USA, 92:6522-6526 (1995)). Other systems include FK506 dimer, VP16 or p65 using astradiol, RU486, diphenol murislerone, or rapamycin. Inducible systems are available from Invitrogen, Clontech and Ariad.

Regulatable promoters that include a repressor with the operon can be used. In one embodiment, the lac repressor from *E. coli* can function as a transcriptional modulator to regulate transcription from lac operator-bearing mammalian cell promoters (M. Brown et al., Cell, 49:603-612 (1987); Gossen and Bujard (1992); M. Gossen et al., Natl. Acad. Sci. USA, 89:5547-5551 (1992)) combined the tetracycline repressor (tetR) with the transcription activator (VP 16) to create a tetR-mammalian cell transcription activator fusion protein, tTa (tetR-VP 16), with the tetO-bearing minimal promoter derived from the human cytomegalovirus (hCMV) major immediate-early promoter to create a tetR-tet operator system to control gene expression in mammalian cells. In one embodiment, a tetracycline inducible switch is used. The tetracycline repressor (tetR) alone, rather than the tetR-mammalian cell transcription factor fusion derivatives can function as potent trans-modulator to regulate gene expression in mammalian cells when the tetracycline operator is properly positioned downstream for the TATA element of the CMVIE promoter (Yao et al., Human Gene Therapy, 10 (16): 1392-1399 (2003)). One particular advantage of this tetracycline inducible switch is that it does not require the use of a tetracycline repressor-mammalian cells transactivator or repressor fusion protein, which in some instances can be toxic to cells (Gossen et al., Natl. Acad. Sci. USA, 89:5547-5551 (1992); Shockett et al., Proc. Natl. Acad. Sci. USA, 92:6522-6526 (1995)), to achieve its regulatable effects.

Additionally, the vector can contain, for example, some or all of the following: a selectable marker gene, such as the neomycin gene for selection of stable or transient transfectants in mammalian cells; enhancer/promoter sequences from the immediate early gene of human CMV for high levels of transcription; transcription termination and RNA processing signals from SV40 for mRNA stability; SV40 polyoma origins of replication and ColE1 for proper episomal replication; internal ribosome binding sites (IRESes), versatile multiple cloning sites; and T7 and SP6 RNA promoters for in vitro transcription of sense and antisense RNA. Suitable vectors and methods for producing vectors containing transgenes are well known and available in the art.

Examples of polyadenylation signals useful to practice the methods described herein include, but are not limited to, human collagen I polyadenylation signal, human collagen II polyadenylation signal, and SV40 polyadenylation signal.

One or more vectors (e.g., expression vectors) comprising nucleic acids encoding any of the antibodies may be introduced into suitable host cells for producing the antibodies. The host cells can be cultured under suitable conditions for expression of the antibody or any polypeptide chain thereof. Such antibodies or polypeptide chains thereof can be recovered by the cultured cells (e.g., from the cells or the culture supernatant) via a conventional method, e.g., affinity purification. If necessary, polypeptide chains of the antibody can be incubated under suitable conditions for a suitable period of time allowing for production of the antibody.

In some embodiments, methods for preparing an antibody described herein involve a recombinant expression vector that encodes both the heavy chain and the light chain of an antibody (including bi-specific antibody) as also described herein. The recombinant expression vector can be introduced into a suitable host cell (e.g., a dhfr-CHO cell) by a conventional method, e.g., calcium phosphate-mediated transfection. Positive transformant host cells can be selected and cultured under suitable conditions allowing for the expression of the two polypeptide chains that form the antibody, which can be recovered from the cells or from the culture medium. When necessary, the two chains recovered from the host cells can be incubated under suitable conditions allowing for the formation of the antibody.

In one example, two recombinant expression vectors are provided, one encoding a first chain (e.g., a heavy chain) of the antibody and the other encoding a second chain (e.g., a light chain) of the antibody. Both of the two recombinant expression vectors can be introduced into a suitable host cell (e.g., dhfr-CHO cell) by a conventional method, e.g., calcium phosphate-mediated transfection. Alternatively, each of the expression vectors can be introduced into a suitable host cells. Positive transformants can be selected and cultured under suitable conditions allowing for the expression of the polypeptide chains of the antibody. When the two expression vectors are introduced into the same host cells, the antibody produced therein can be recovered from the host cells or from the culture medium. If necessary, the polypeptide chains can be recovered from the host cells or from the culture medium and then incubated under suitable conditions allowing for formation of the antibody. When the two expression vectors are introduced into different host cells, each of them can be recovered from the corresponding host cells or from the corresponding culture media. The two polypeptide chains can then be incubated under suitable conditions for formation of the antibody.

Standard molecular biology techniques are used to prepare the recombinant expression vector, transfect the host cells, select for transformants, culture the host cells and recovery of the antibodies from the culture medium. For example, some antibodies can be isolated by affinity chromatography with a Protein A or Protein G coupled matrix.

Any of the nucleic acids encoding the first chain (e.g., the heavy chain), the second chain (e.g., the light chain), or both of an antibody as described herein, vectors (e.g., expression vectors) containing such; and host cells comprising the vectors are within the scope of the present disclosure.

III. Pharmaceutical Compositions

Any of the antibodies, including bi-specific antibodies disclosed herein, as well as the encoding nucleic acids or nucleic acid sets, vectors comprising such, or host cells comprising the vectors, as described herein can be mixed with a pharmaceutically acceptable carrier (excipient) to form a pharmaceutical composition for use in treating a target disease. "Acceptable" means that the carrier must be compatible with the active ingredient of the composition (and preferably, capable of stabilizing the active ingredient) and not deleterious to the subject to be treated. Pharmaceutically acceptable excipients (carriers) including buffers, which are well known in the art. See, e.g., Remington: The Science and Practice of Pharmacy 20th Ed. (2000) Lippincott Williams and Wilkins, Ed. K. E. Hoover.

The pharmaceutical compositions to be used in the present methods can comprise pharmaceutically acceptable carriers, excipients, or stabilizers in the form of lyophilized formulations or aqueous solutions. (Remington: The Science and Practice of Pharmacy 20th Ed. (2000) Lippincott Williams and Wilkins, Ed. K. E. Hoover). Acceptable carriers, excipients, or stabilizers are nontoxic to recipients at the dosages and concentrations used, and may comprise buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium 1 chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

In some examples, the pharmaceutical composition described herein comprises liposomes containing the antibodies (or the encoding nucleic acids) which can be prepared by methods known in the art, such as described in Epstein, et al., *Proc. Natl. Acad. Sci. USA* 82:3688 (1985); Hwang, et al., *Proc. Natl. Acad. Sci. USA* 77:4030 (1980); and U.S. Pat. Nos. 4,485,045 and 4,544,545. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter.

The antibodies, or the encoding nucleic acid(s), may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are known in the art, see, e.g., Remington, The Science and Practice of Pharmacy 20th Ed. Mack Publishing (2000).

In other examples, the pharmaceutical composition described herein can be formulated in sustained-release format. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinyl alcohol)), polylactides (U.S. Pat. No. 3,773,919), copolymers of L-glutamic acid and 7 ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), sucrose acetate isobutyrate, and poly-D-(−)-3-hydroxybutyric acid.

The pharmaceutical compositions to be used for in vivo administration must be sterile. This is readily accomplished by, for example, filtration through sterile filtration membranes. Therapeutic antibody compositions are generally placed into a container having a sterile access port, for example, an intravenous solution bag or vial having a stopper pierceable by a hypodermic injection needle.

The pharmaceutical compositions described herein can be in unit dosage forms such as tablets, pills, capsules, powders, granules, solutions or suspensions, or suppositories, for oral, parenteral or rectal administration, or administration by inhalation or insufflation.

For preparing solid compositions such as tablets, the principal active ingredient can be mixed with a pharmaceutical carrier, e.g., conventional tableting ingredients such as corn starch, lactose, sucrose, sorbitol, talc, stearic acid, magnesium stearate, dicalcium phosphate or gums, and other pharmaceutical diluents, e.g., water, to form a solid preformulation composition containing a homogeneous mixture of a compound of the present invention, or a non-toxic pharmaceutically acceptable salt thereof. When referring to these preformulation compositions as homogeneous, it is meant that the active ingredient is dispersed evenly throughout the composition so that the composition may be readily subdivided into equally effective unit dosage forms such as tablets, pills and capsules. This solid preformulation composition is then subdivided into unit dosage forms of the type described above containing from 0.1 to about 500 mg of the active ingredient of the present invention. The tablets or pills of the novel composition can be coated or otherwise compounded to provide a dosage form affording the advantage of prolonged action. For example, the tablet or pill can comprise an inner dosage and an outer dosage component, the latter being in the form of an envelope over the former. The two components can be separated by an enteric layer that serves to resist disintegration in the stomach and permits the inner component to pass intact into the duodenum or to be delayed in release. A variety of materials can be used for such enteric layers or coatings, such materials including a number of polymeric acids and mixtures of polymeric acids with such materials as shellac, cetyl alcohol and cellulose acetate.

Suitable surface-active agents include, in particular, nonionic agents, such as polyoxyethylenesorbitans (e.g., Tween™ 20, 40, 60, 80 or 85) and other sorbitans (e.g., Span™ 20, 40, 60, 80 or 85). Compositions with a surface-active agent will conveniently comprise between 0.05 and 5% surface-active agent, and can be between 0.1 and 2.5%. It will be appreciated that other ingredients may be added, for example mannitol or other pharmaceutically acceptable vehicles, if necessary.

Suitable emulsions may be prepared using commercially available fat emulsions, such as Intralipid™, Liposyn™, Infonutrol™, Lipofundin™ and Lipiphysan™. The active ingredient may be either dissolved in a pre-mixed emulsion composition or alternatively it may be dissolved in an oil (e.g., soybean oil, safflower oil, cottonseed oil, sesame oil, corn oil or almond oil) and an emulsion formed upon mixing with a phospholipid (e.g. egg phospholipids, soybean phospholipids or soybean lecithin) and water. It will be appreciated that other ingredients may be added, for example glycerol or glucose, to adjust the tonicity of the emulsion. Suitable emulsions will typically contain up to 20% oil, for example, between 5 and 20%. The fat emulsion can comprise fat droplets between 0.1 and 1.0 μm, particularly 0.1 and 0.5 μm, and have a pH in the range of 5.5 to 8.0.

The emulsion compositions can be those prepared by mixing an antibody with Intralipid™ or the components thereof (soybean oil, egg phospholipids, glycerol and water).

Pharmaceutical compositions for inhalation or insufflation include solutions and suspensions in pharmaceutically acceptable, aqueous or organic solvents, or mixtures thereof, and powders. The liquid or solid compositions may contain suitable pharmaceutically acceptable excipients as set out above. In some embodiments, the compositions are administered by the oral or nasal respiratory route for local or systemic effect.

Compositions in preferably sterile pharmaceutically acceptable solvents may be nebulized by use of gases. Nebulized solutions may be breathed directly from the nebulizing device or the nebulizing device may be attached to a face mask, tent or intermittent positive pressure breathing machine. Solution, suspension or powder compositions may be administered, preferably orally or nasally, from devices which deliver the formulation in an appropriate manner.

IV. Therapeutic Applications

Any of the anti-CD40 antibodies, anti-PD-L1 antibodies, anti-B7H3 antibodies, and anti-B7H4 antibodies, as well as the anti-CD40/PD-1 bi-specific antibodies, anti-CD40/PD-L1 bi-specific antibodies, anti-CD40/B7H3 bi-specific antibodies, anti-CD40/B7H4 bi-specific antibodies, anti-CD40/CEA bi-specific antibodies, anti-CD40/TNT bi-specific antibodies, and anti-CD40/HER2 bi-specific antibodies may be used in clinical settings (e.g., therapeutic or diagnostic) or in non-clinical settings (e.g., for research purposes).

In some aspects, provided herein are methods of using any of the antibodies disclosed herein for modulating immune responses or for treating a targeting disease in a subject in need of the treatment. To practice the method disclosed herein, an effective amount of the pharmaceutical composition described herein can be administered to a subject (e.g., a human) in need of the treatment via a suitable route, such as intravenous administration, e.g., as a bolus or by continuous infusion over a period of time, by intramuscular, intraperitoneal, intracerebrospinal, subcutaneous, intra-articular, intrasynovial, intrathecal, oral, inhalation or topical routes. Commercially available nebulizers for liquid formulations, including jet nebulizers and ultrasonic nebulizers are useful for administration. Liquid formulations can be directly nebulized and lyophilized powder can be nebulized after reconstitution. Alternatively, the antibodies as described herein can be aerosolized using a fluorocarbon formulation and a metered dose inhaler, or inhaled as a lyophilized and milled powder.

The subject to be treated by the methods described herein can be a mammal, more preferably a human. Mammals include, but are not limited to, farm animals, sport animals, pets, primates, horses, dogs, cats, mice and rats. A human subject who needs the treatment may be a human patient having, at risk for, or suspected of having a target disease/disorder, such as a cancer or an immune disorder such as an autoimmune disease.

Examples of cancers include, but are not limited to, breast cancer; biliary tract cancer; bladder cancer; brain cancer including glioblastomas and medulloblastomas; cervical cancer; choriocarcinoma; colon cancer; endometrial cancer; esophageal cancer; gastric cancer; hematological neoplasms including acute lymphocytic and myelogenous leukemia, e.g., B Cell CLL; T-cell acute lymphoblastic leukemia/lymphoma; hairy cell leukemia; chronic myelogenous leukemia, multiple myeloma; AIDS-associated leukemias and adult T-cell leukemia/lymphoma; intraepithelial neoplasms including Bowen's disease and Paget's disease; liver cancer; lung cancer; lymphomas including Hodgkin's disease and lymphocytic lymphomas; neuroblastomas; oral cancer including squamous cell carcinoma; ovarian cancer including those arising from epithelial cells, stromal cells, germ cells and mesenchymal cells; pancreatic cancer; prostate cancer; rectal cancer; sarcomas including leiomyosarcoma, rhabdomyosarcoma, liposarcoma, fibrosarcoma, and osteosarcoma; skin cancer including melanoma, Merkel cell carcinoma, Kaposi's sarcoma, basal cell carcinoma, and squamous cell cancer; testicular cancer including germinal tumors such as seminoma, non-seminoma (teratomas, choriocarcinomas), stromal tumors, and germ cell tumors; thyroid cancer including thyroid adenocarcinoma and medullar carcinoma; and renal cancer including adenocarcinoma and Wilms tumor.

A subject having a target cancer can be identified by routine medical examination, e.g., laboratory tests, organ functional tests, CT scans, ultrasounds, and/or genetic testing. In some embodiments, the subject to be treated by the method described herein may be a human cancer patient who has undergone or is subjecting to an anti-cancer therapy, for example, chemotherapy, radiotherapy, immunotherapy, or surgery.

Immune disorders refer to a dysfunction of the immune system. Examples include autoimmune diseases, immunodeficiencies, or allergies. In some embodiments, the target disease for treatment is an autoimmune disease. Examples include, but are not limited to, rheumatoid arthritis (RA), systemic lupus erythematosus (SLE), Myasthenia Gravis (MG), Graves' Disease, Idiopathic Thrombocytopenia Purpura (ITP), Guillain-Barre Syndrome, autoimmune myocarditis, Membrane Glomerulonephritis, Hyper IgM syndrome, diabetes mellitus, Type I or Type II diabetes, multiple sclerosis, Reynaud's syndrome, autoimmune thyroiditis, gastritis, Celiac Disease, Vitiligo, Hepatitis, primary biliary cirrhosis, inflammatory bowel disease, spondyloarthropathies, experimental autoimmune encephalomyelitis, immune neutropenia, juvenile onset diabetes, and immune responses associated with delayed hypersensitivity mediated by cytokines, T-lymphocytes typically found in tuberculosis, sarcoidosis, and polymyositis, polyarteritis, cutaneous vasculitis, pemphigus, pemphigold, Goodpasture's syndrome, Kawasaki's disease, systemic sclerosis, anti-phospholipid syndrome, Sjogren's syndrome, graft-versus-host (GVH) disease, and immune thrombocytopenia.

A subject having a target autoimmune disease can be identified by routine medical examination, e.g., presence of antinuclear antibodies, anti-mitochondrial autoantibodies, anti-neutrophil cytoplasmic antibody, anti-phospholipid antibodies, anti-citrullinated peptide (anti-CCP), anti-rheumatoid factor, immunoglobulin A, C-reactive protein test, complement test, erythrocyte sedimentation rate (ESR) test, blood clotting profile, and protein electrophoresis/immunofixation electrophoresis, and/or genetic testings. In some embodiments, the subject to be treated by the method described herein may be a human subject with an autoimmune disease who has undergone or is subjecting to an autoimmune disease treatment, for example, immunosuppressive mediation, hormone replacement therapy, blood transfusions, anti-inflammatory medication, and/or pain medication.

A subject suspected of having any of such target disease/disorder might show one or more symptoms of the disease/disorder. A subject at risk for the disease/disorder can be a subject having one or more of the risk factors for that disease/disorder.

As used herein, "an effective amount" refers to the amount of each active agent required to confer therapeutic effect on the subject, either alone or in combination with one or more other active agents. Determination of whether an amount of the antibody achieved the therapeutic effect would be evident to one of skill in the art. Effective amounts vary, as recognized by those skilled in the art, depending on the particular condition being treated, the severity of the condition, the individual patient parameters including age, physical condition, size, gender and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment.

Empirical considerations, such as the half-life, generally will contribute to the determination of the dosage. For example, antibodies that are compatible with the human immune system, such as humanized antibodies or fully human antibodies, may be used to prolong half-life of the antibody and to prevent the antibody being attacked by the host's immune system. Frequency of administration may be determined and adjusted over the course of therapy, and is generally, but not necessarily, based on treatment and/or suppression and/or amelioration and/or delay of a target disease/disorder. Alternatively, sustained continuous release formulations of an antibody may be appropriate. Various formulations and devices for achieving sustained release are known in the art.

In one example, dosages for an antibody as described herein may be determined empirically in individuals who have been given one or more administration(s) of the antibody. Individuals are given incremental dosages of the agonist. To assess efficacy of the agonist, an indicator of the disease/disorder can be followed.

Generally, for administration of any of the antibodies described herein, an initial candidate dosage can be about 2 mg/kg. For the purpose of the present disclosure, a typical daily dosage might range from about any of 0.1 µg/kg to 3 µg/kg to 30 µg/kg to 300 µg/kg to 3 mg/kg, to 30 mg/kg to 100 mg/kg or more, depending on the factors mentioned above. For repeated administrations over several days or longer, depending on the condition, the treatment is sustained until a desired suppression of symptoms occurs or until sufficient therapeutic levels are achieved to alleviate a target disease or disorder, or a symptom thereof. An exemplary dosing regimen comprises administering an initial dose of about 2 mg/kg, followed by a weekly maintenance dose of about 1 mg/kg of the antibody, or followed by a maintenance dose of about 1 mg/kg every other week. However, other dosage regimens may be useful, depending on the pattern of pharmacokinetic decay that the practitioner wishes to achieve. For example, dosing from one-four times a week is contemplated. In some embodiments, dosing ranging from about 3 µg/mg to about 2 mg/kg (such as about 3 µg/mg, about 10 µg/mg, about 30 µg/mg, about 100 µg/mg, about 300 µg/mg, about 1 mg/kg, and about 2 mg/kg) may be used. In some embodiments, dosing frequency is once every week, every 2 weeks, every 4 weeks, every 5 weeks, every 6 weeks, every 7 weeks, every 8 weeks, every 9 weeks, or every 10 weeks; or once every month, every 2 months, or every 3 months, or longer. The progress of this therapy is easily monitored by conventional techniques and assays. The dosing regimen (including the antibody used) can vary over time.

In some embodiments, for an adult patient of normal weight, doses ranging from about 0.3 to 5.00 mg/kg may be administered. In some examples, the dosage of the antibody described herein can be 10 mg/kg. The particular dosage regimen, i.e., dose, timing and repetition, will depend on the particular individual and that individual's medical history, as well as the properties of the individual agents (such as the half-life of the agent, and other considerations well known in the art).

For the purpose of the present disclosure, the appropriate dosage of an antibody as described herein will depend on the specific antibody, antibodies, and/or non-antibody peptide (or compositions thereof) employed, the type and severity of the disease/disorder, whether the antibody is administered for preventive or therapeutic purposes, previous therapy, the patient's clinical history and response to the agonist, and the discretion of the attending physician. Typically the clinician will administer an antibody, until a dosage is reached that achieves the desired result. In some embodiments, the desired result is an increase in anti-tumor immune response in the tumor microenvironment. Methods of determining whether a dosage resulted in the desired result would be evident to one of skill in the art. Administration of one or more antibodies can be continuous or intermittent, depending, for example, upon the recipient's physiological condition, whether the purpose of the administration is therapeutic or prophylactic, and other factors known to skilled practitioners. The administration of an antibody may be essentially continuous over a preselected period of time or may be in a series of spaced dose, e.g., either before, during, or after developing a target disease or disorder.

As used herein, the term "treating" refers to the application or administration of a composition including one or more active agents to a subject, who has a target disease or disorder, a symptom of the disease/disorder, or a predisposition toward the disease/disorder, with the purpose to cure, heal, alleviate, relieve, alter, remedy, ameliorate, improve, or affect the disorder, the symptom of the disease, or the predisposition toward the disease or disorder.

Alleviating a target disease/disorder includes delaying the development or progression of the disease, or reducing disease severity or prolonging survival. Alleviating the disease or prolonging survival does not necessarily require curative results. As used therein, "delaying" the development of a target disease or disorder means to defer, hinder, slow, retard, stabilize, and/or postpone progression of the disease. This delay can be of varying lengths of time, depending on the history of the disease and/or individuals being treated. A method that "delays" or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset. As used herein "onset" or "occurrence" of a target disease or disorder includes initial onset and/or recurrence.

Conventional methods, known to those of ordinary skill in the art of medicine, can be used to administer the pharmaceutical composition to the subject, depending upon the type of disease to be treated or the site of the disease. This composition can also be administered via other conventional routes, e.g., administered orally, parenterally, by inhalation spray, topically, rectally, nasally, buccally, vaginally or via an implanted reservoir. The term "parenteral" as used herein includes subcutaneous, intracutaneous, intravenous, intramuscular, intraarticular, intraarterial, intrasynovial, intrasternal, intrathecal, intralesional, and intracranial injection or infusion techniques. In addition, it can be administered to the subject via injectable depot routes of administration such as using 1-, 3-, or 6-month depot injectable or biodegradable materials and methods. In some examples, the pharmaceutical composition is administered intraocularly or intravitreally.

Injectable compositions may contain various carriers such as vegetable oils, dimethylactamide, dimethyformamide, ethyl lactate, ethyl carbonate, isopropyl myristate, ethanol, and polyols (glycerol, propylene glycol, liquid polyethylene glycol, and the like). For intravenous injection, water soluble antibodies can be administered by the drip method, whereby a pharmaceutical formulation containing the antibody and a physiologically acceptable excipient is infused. Physiologically acceptable excipients may include, for example, 5% dextrose, 0.9% saline, Ringer's solution or other suitable excipients. Intramuscular preparations, e.g., a sterile formulation of a suitable soluble salt form of the antibody, can be dissolved and administered in a pharmaceutical excipient such as Water-for-Injection, 0.9% saline, or 5% glucose solution.

In one embodiment, an antibody is administered via site-specific or targeted local delivery techniques. Examples of site-specific or targeted local delivery techniques include various implantable depot sources of the antibody or local delivery catheters, such as infusion catheters, an indwelling catheter, or a needle catheter, synthetic grafts, adventitial wraps, shunts and stents or other implantable devices, site specific carriers, direct injection, or direct application. See, e.g., PCT Publication No. WO 00/53211 and U.S. Pat. No. 5,981,568.

Targeted delivery of therapeutic compositions containing an antisense polynucleotide, expression vector, or subgenomic polynucleotides can also be used. Receptor-mediated DNA delivery techniques are described in, for example, Findeis et al., *Trends Biotechnol*. (1993) 11:202; Chiou et al., Gene Therapeutics: Methods and Applications Of Direct Gene Transfer (J. A. Wolff, ed.) (1994); Wu et al., *J. Biol. Chem*. (1988) 263:621; Wu et al., *J. Biol. Chem*. (1994) 269:542; Zenke et al., *Proc. Natl. Acad. Sci. USA* (1990) 87:3655; Wu et al., *J. Biol. Chem*. (1991) 266:338.

Therapeutic compositions containing a polynucleotide (e.g., those encoding the antibodies described herein) are administered in a range of about 100 ng to about 200 mg of DNA for local administration in a gene therapy protocol. In some embodiments, concentration ranges of about 500 ng to about 50 mg, about 1 µg to about 2 mg, about 5 µg to about 500 µg, and about 20 µg to about 100 µg of DNA or more can also be used during a gene therapy protocol.

The therapeutic polynucleotides and polypeptides described herein can be delivered using gene delivery vehicles. The gene delivery vehicle can be of viral or non-viral origin (see generally, Jolly, *Cancer Gene Therapy* (1994) 1:51; Kimura, *Human Gene Therapy* (1994) 5:845; Connelly, *Human Gene Therapy* (1995) 1:185; and Kaplitt, *Nature Genetics* (1994) 6:148). Expression of such coding sequences can be induced using endogenous mammalian or heterologous promoters and/or enhancers. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., PCT Publication Nos. WO 90/07936; WO 94/03622; WO 93/25698; WO 93/25234; WO 93/11230; WO 93/10218; WO 91/02805; U.S. Pat. Nos. 5,219,740 and 4,777,127; GB Patent No. 2,200,651; and EP Patent No. 0 345 242), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532)), and adeno-associated virus (AAV) vectors (see, e.g., PCT Publication Nos. WO 94/12649, WO 93/03769; WO 93/19191; WO 94/28938; WO 95/11984 and WO 95/00655). Administration of DNA linked to killed adenovirus as described in Curiel, *Hum. Gene Ther.* (1992) 3:147 can also be employed.

Non-viral delivery vehicles and methods can also be employed, including, but not limited to, polycationic condensed DNA linked or unlinked to killed adenovirus alone (see, e.g., Curiel, *Hum. Gene Ther*. (1992) 3:147); ligand-linked DNA (see, e.g., Wu, *J. Biol. Chem*. (1989) 264: 16985); eukaryotic cell delivery vehicles cells (see, e.g., U.S. Pat. No. 5,814,482; PCT Publication Nos. WO 95/07994; WO 96/17072; WO 95/30763; and WO 97/42338) and nucleic charge neutralization or fusion with cell membranes. Naked DNA can also be employed. Exemplary naked DNA introduction methods are described in PCT Publication No. WO 90/11092 and U.S. Pat. No. 5,580,859. Liposomes that can act as gene delivery vehicles are described in U.S. Pat. No. 5,422,120; PCT Publication Nos. WO 95/13796; WO 94/23697; WO 91/14445; and EP U.S. Pat. No. 524,968. Additional approaches are described in Philip, *Mol. Cell. Biol.* (1994) 14:2411, and in Woffendin, *Proc. Natl. Acad. Sci.* (1994) 91:1581.

The particular dosage regimen, i.e., dose, timing and repetition, used in the method described herein will depend on the particular subject and that subject's medical history.

In some embodiments, more than one antibody, or a combination of an antibody and another suitable therapeutic agent, may be administered to a subject in need of the treatment. The antibody can also be used in conjunction with other agents that serve to enhance and/or complement the effectiveness of the agents. Treatment efficacy for a target disease/disorder can be assessed by methods well-known in the art.

When any of the antibodies described herein is used for treating a cancer, it can be combined with an anti-cancer therapy, for example, those known in the art. Additional anti-cancer therapy includes chemotherapy, surgery, radiation, immunotherapy, gene therapy, and so forth.

Alternatively, the treatment of the present disclosure can be combined with a chemotherapeutic agent, for example, pyrimidine analogs (5-fluorouracil, floxuridine, capecitabine, gemcitabine and cytarabine), purine analogs, folate antagonists and related inhibitors (mercaptopurine, thioguanine, pentostatin and 2-chlorodeoxyadenosine (cladribine)); antiproliferative/antimitotic agents including natural products such as *vinca* alkaloids (vinblastine, vincristine, and vinorelbine), microtubule disruptors such as taxane (paclitaxel, docetaxel), vincristin, vinblastin, nocodazole, epothilones and navelbine, epidipodophyllotoxins (etoposide, teniposide), DNA damaging agents (actinomycin, amsacrine, anthracyclines, bleomycin, busulfan, camptothecin, carboplatin, chlorambucil, cisplatin, cyclophosphamide, cytoxan, dactinomycin, daunorubicin, doxorubicin, epirubicin, hexamethyhnelamineoxaliplatin, iphosphamide, melphalan, merchlorehtamine, mitomycin, mitoxantrone, nitrosourea, plicamycin, procarbazine, taxol, taxotere, teniposide, triethylenethiophosphoramide and etoposide (VP16)); antibiotics such as dactinomycin (actinomycin D), daunorubicin, doxorubicin (adriamycin), idarubicin, anthracyclines, mitoxantrone, bleomycins, plicamycin (mithramycin) and mitomycin; enzymes (L-asparaginase which systemically metabolizes L-asparagine and deprives cells which do not have the capacity to synthesize their own asparagine); antiplatelet agents; antiproliferative/antimitotic alkylating agents such as nitrogen mustards (mechlorethamine, cyclophosphamide and analogs, melphalan, chlorambucil), ethylenimines and methylmelamines (hexamethylmelamine and thiotepa), alkyl sulfonates-busulfan, nitrosoureas (carmustine (BCNU) and analogs, streptozocin), trazenes-dacarbazinine (DTIC); antiproliferative/antimitotic antimetabolites such as folic acid analogs (methotrexate); platinum coordination complexes (cisplatin, carboplatin), procarbazine, hydroxyurea, mitotane, aminoglutethimide; hormones, hormone analogs (estrogen, tamoxifen, goserelin, bicalutamide, nilutamide) and aromatase inhibitors (letrozole, anastrozole); anticoagulants (heparin, synthetic heparin salts and other inhibitors of thrombin); fibrinolytic agents (such as tissue plasminogen activator, streptokinase and urokinase), aspirin, dipyridamole, ticlopidine, clopidogrel, abciximab; antimigratory agents; antisecretory agents (breveldin); immunosuppressives (cyclosporine, tacrolimus (FK-506), sirolimus (rapamycin), azathioprine, mycophenolate mofetil); anti-angiogenic compounds (e.g., TNP-470, genistein, bevacizumab) and growth factor inhibitors (e.g., fibroblast growth factor (FGF) inhibitors); angiotensin receptor blocker; nitric oxide donors; anti-sense oligonucleotides; antibodies (trastuzumab); cell cycle inhibitors and differentiation inducers (tretinoin); mTOR inhibitors, topoisomerase inhibitors (doxorubicin (adriamycin), amsacrine, camptothecin, daunorubicin, dactinomycin, eniposide, epirubicin, etoposide, idarubicin and mitoxantrone, topotecan, irinotecan), corticosteroids (cortisone, dexamethasone, hydrocortisone, methylpednisolone, prednisone, and prenisolone); growth factor signal transduction kinase inhibitors; mitochondrial dysfunction inducers and caspase activators; and chromatin disruptors.

When any of the antibodies described herein is for use in treating an immune disorder, it can be co-used with other immunomodulatory treatments such as, e.g., therapeutic vaccines (including but not limited to GVAX, DC-based vaccines, etc.), or checkpoint inhibitors (including but not limited to agents that block CTLA4, PD1, LAG3, TIM3, etc.). In some instances, the antibody can be combined with another therapy for autoimmune diseases. Examples include, but are not limited to, intravenous Ig therapy; nonsteroidal anti-inflammatory drugs (NSAID); corticosteroids; cyclosporins, rapamycins, ascomycins; cyclophosphamide; azathioprene; methotrexate; brequinar; FTY 720; leflunomide; mizoribine; mycophenolic acid; mycophenolate mofetil; 15-deoxyspergualine; an immunosuppressive agent, or an adhesion molecule inhibitor.

For examples of additional useful agents see also Physician's Desk Reference, 59.sup.th edition, (2005), Thomson P D R, Montvale N.J.; Gennaro et al., Eds. Remington's The Science and Practice of Pharmacy 20.sup.th edition, (2000), Lippincott Williams and Wilkins, Baltimore Md.; Braunwald et al., Eds. Harrison's Principles of Internal Medicine, 15.sup.th edition, (2001), McGraw Hill, NY; Berkow et al., Eds. The Merck Manual of Diagnosis and Therapy, (1992), Merck Research Laboratories, Rahway N.J.

When a second therapeutic agent is used, such an agent can be administered simultaneously or sequentially (in any order) with the therapeutic agent described herein. When co-administered with an additional therapeutic agent, suitable therapeutically effective dosages for each agent may be lowered due to the additive action or synergy.

V. Kits Comprising Antibodies Disclosed Herein

The present disclosure also provides kits for use in treating or alleviating a target disease, such as cancer or immune disorders as described herein. Such kits can include one or more containers comprising an anti-CD40 antibody, anti-PD-L1 antibody, anti-B7H3 antibody, and anti-B7H4 antibody, anti-CD40/PD-1 bi-specific antibody, anti-CD40/PD-L1 bi-specific antibody, anti-CD40/B7H3 bi-specific antibody, anti-CD40/B7H4 bi-specific antibody, anti-CD40/CEA bi-specific antibody, anti-CD40/TNT bi-specific antibody, and/or anti-CD40/HER2 bi-specific antibody, e.g., any of those described herein, and optionally a second therapeutic agent to be co-used with the antibody, which is also described herein.

In some embodiments, the kit can comprise instructions for use in accordance with any of the methods described herein. The included instructions can comprise a description of administration of the antibody, and optionally the second therapeutic agent, to treat, delay the onset, or alleviate a target disease as those described herein. The kit may further comprise a description of selecting an individual suitable for treatment based on identifying whether that individual has the target disease, e.g., applying the diagnostic method as described herein. In still other embodiments, the instructions comprise a description of administering an antibody to an individual at risk of the target disease.

The instructions relating to the use of an antibody generally include information as to dosage, dosing schedule, and route of administration for the intended treatment. The containers may be unit doses, bulk packages (e.g., multi-dose packages) or sub-unit doses. Instructions supplied in the kits of the invention are typically written instructions on a label or package insert (e.g., a paper sheet included in the kit), but machine-readable instructions (e.g., instructions carried on a magnetic or optical storage disk) are also acceptable.

The label or package insert indicates that the composition is used for treating, delaying the onset and/or alleviating the disease, such as cancer or immune disorders (e.g., an auto-immune disease). Instructions may be provided for practicing any of the methods described herein.

The kits of this invention are in suitable packaging. Suitable packaging includes, but is not limited to, vials, bottles, jars, flexible packaging (e.g., sealed Mylar or plastic bags), and the like. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle). The container may also have a sterile access port (for example the container may be an intravenous solution bag or a vial having a stopper pierceable by a hypodermic injection needle). At least one active agent in the composition is an antibody as those described herein.

Kits may optionally provide additional components such as buffers and interpretive information. Normally, the kit comprises a container and a label or package insert(s) on or associated with the container. In some embodiments, the invention provides articles of manufacture comprising contents of the kits described above.

General Techniques

The practice of the present disclosure will employ, unless otherwise indicated, conventional techniques of molecular biology (including recombinant techniques), microbiology, cell biology, biochemistry, and immunology, which are within the skill of the art. Such techniques are explained fully in the literature, such as *Molecular Cloning: A Laboratory Manual*, second edition (Sambrook, et al., 1989) Cold Spring Harbor Press; *Oligonucleotide Synthesis* (M. J. Gait, ed. 1984); *Methods in Molecular Biology*, Humana Press; *Cell Biology: A Laboratory Notebook* (J. E. Cellis, ed., 1989) Academic Press; Animal Cell Culture (R. I. Freshney, ed. 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds. 1993-8) J. Wiley and Sons; Methods in Enzymology (Academic Press, Inc.); Handbook of Experimental Immunology (D. M. Weir and C. C. Blackwell, eds.): Gene Transfer Vectors for Mammalian Cells (J. M. Miller and M. P. Calos, eds., 1987); Current Protocols in Molecular Biology (F. M. Ausubel, et al. eds. 1987); PCR: The Polymerase Chain Reaction, (Mullis, et al., eds. 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practice approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds. Harwood Academic Publishers, 1995); *DNA Cloning: A practical Approach*, Volumes I and II (D. N. Glover ed. 1985); *Nucleic Acid Hybridization* (B. D. Hames & S. J. Higgins eds. (1985»; *Transcription and Translation* (B. D. Hames & S. J. Higgins, eds. (1984»; *Animal Cell Culture* (R. I. Freshney, ed. (1986»; *Immobilized Cells and Enzymes* (IRL Press, (1986»; and B. Perbal, *A practical Guide To Molecular Cloning* (1984); F. M. Ausubel et al. (eds.).

Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

Example 1: Construction of Humanized Antibodies Specific to CD40

This example provides exemplary humanized anti-CD40 antibodies derived from two murine parent anti-CD40 antibodies, LYV377 and LYV378.

(i) Humanized Anti-CD40 Antibodies Derived from LYV377

The $V_H$ and $V_L$ sequences of murine LYV377 are provided below (CDR regions in boldface as identified using the Kabat CDR definitions):

```
>LYV377_VH
                                    (SEQ ID NO: 71)
EVQILETGGGLVKPGGSLRLSCATSGFNFNDSFMNW

VRQAPGKGLEWVAQIRNKNYNYATYYTESLEGRVTI

SRDDSKSRVYLQVSSLRAEDSAVYYCTSYYYDGFAD

YFDYWGQGVMVTVSS

>LYV377_VL
                                    (SEQ ID NO: 72)
DIKMTQSPSFLSASVGDSVTFTCKASQNIYIYLNWY

QQKFGEAPKLLIYNTNNLQTGIPSRFSGSESGTVFT

LTISSLQPEDVATYFCLQHSSRRTFGGGTKLELKR
```

Sequence alignments were performed to compare the LYV377 VH and VL to human germline VH and VL sequences, respectively, following methods known in the art. See, e.g., Glanville J. et al. PNAS 2009; 106 (48) 20216-21. Based on overall sequence identity, matching interface positions and similarly classed CDR canonical positions, a germline family was identified for each of the light and heavy chains as the desired acceptor frameworks, i.e., IGKV1-39*01 for the light chain and IGHV3-73*01 for the heavy chain. Human acceptors were identified as ACJ71716.1 immunoglobulin kappa light chain and CAF28444.1 immunoglobulin heavy chain variable region, the amino acid sequences of which are shown below:

```
>CAF28444.1 Human VH acceptor sequence
                                    (SEQ ID NO: 73)
EVQLVESGGGLVQPGGSLKLSCAASGFTFSGSAMHW

VRQASGKGLEWVGRIRSKANSYATAYAASVKGRFTI

SRDDSKNTAYLQMNSLKTEDTAVYYCTRLVADGGWY

GMDVWGQGTTVTVSS

>ACJ71716.1 Human VL acceptor sequence
                                    (SEQ ID NO: 74)
DIQMTQSPSSLSASVGDRVTITCRASQSISSYLNWY

QQKPGKAPKLLIYAASSLQSGVPSRFSGSGSGTDFT

LTISSLQPEDFATYYCOOSYSTPRTFGGGTKVEIKR

TVAAPSVFIFPPSDEQLKSGTASVVCLLNN
```

The CDRs of the parent LYV377 antibody were grafted into the corresponding CDR regions of the above-noted human VH and VL acceptor sequences to generate humanized LYV377_VH-1 and LYV377_VL-1 chains (grafted humanized antibody), the amino acid sequence of each of which is provided below (CDRs in boldface):

```
>LYV377_VH-1
          (grafted LYV377_VH; SEQ ID NO: 10)
EVQLVESGGGLVQPGGSLKLSCAASGFNFNDSFMN

WVRQASGKGLEWVGQIRNKNYNYATYYTESLEGRF

TISRDDSKNTAYLQMNSLKTEDTAVYYCTRYYYDG

FADYFDYWGQGTTVTVSS
```

-continued

```
>LYV377_VL-1
          (grafted LYV377_VL; SEQ ID NO: 15)
DIQMTQSPSSLSASVGDRVTITCKASQNIYIYLNW

YQQKPGKAPKLLIYNTNNLQTGVPSRFSGSGSGTD

FTLTISSLQPEDFATYYCLQHSSRRTFGGGTKVEI

KR
```

Homology modeling of LYV377 antibody Fv fragments was carried out as follows. Briefly, the LYV377 VH and VL sequences were BLAST searched against the PDB antibody database to identify a suitable template for Fv fragments and especially for building the domain interface. Structural template 2UZI (CRYSTAL STRUCTURE OF HRAS (G12V)-ANTI-RAS FV COMPLEX) was selected, identity=65%. Amino acid sequence alignment between LYV377 antibody and 2UZI template is shown below, where | is the heavy chain/light chain break and * indicates identical amino acid residues in both sequences.

```
2UZI   EVQLLESGGGLVQPGGSLRLSCAASGFTFSTFSMNWVRQAPGKGLEWVSYISRTS--KTI

LYV377 EVQILETGGGLVKPGGSLRLSCATSGFNFNDSFMNWVRQAPGKGLEWVAQIRNKNYNYAT

2UZI   YYADSVKGRFTISRDNSKNTLYLQMNSLRAEDTAVYYCAR------GRFFDYWGQGTLVT

LYV377 YYTESLEGRVTISRDDSKSRVYLQVSSLRAEDSAVYYCTSYYYDGFADYFDYWGQGVMVT

2UZI   VS- | -IQMTQSPSSLSASVGDRVTITCRASQSISSYLNWYQQKPGEAPKLLIYSASVLQSG

LYV377 VSS | DIKMTQSPSFLSASVGDSVTFTCKASQNIYIYLNWYQQKFGEAPKLLIYNTNNLQTG

2UZI   VPSRFSGSGSGTDFTLTISSLQPEDFATYYCQQSVMIPMTFGQGTKVE---(SEQ ID NO: 75)

LYV377 IPSRFSGSESGTVFTLTISSLQPEDVATYFCLQHSS-RRTFGGGTKLELKR(SEQ ID NO: 71)
```

Homology models were built using customized Build Homology Models protocol. Disulfide bridges were specified and linked. Loops were optimized using DOPE method. Based on the homology model of 2UZI, the VH and VL sequences of the LYV377 antibody were analyzed. Framework region (FR) residues that are expected to be important for the binding activity, including canonical FR residues and VH-VL interface residues of the antibody were identified. The framework residues in the inner core were further analyzed and four residues of LYV377_VH-1 (grafted LYV377_VH) were identified for back mutations, including included E1 (surface exposed residue liable to form pyroglutamate), A24 (buried residue with side chain polarity), F70 (buried canonical residue), and R100 (buried residue with side chain charge).

A humanized variant, LYV377_VH-2 (sequence shown below), was designed to include these back mutations (E1Q, A24T, F70V, and R100S, in boldface) and its bioactivity was examined to identify back mutations that would help retain optimal activity, e.g., antigen binding activity, CD40 agonistic activity, and/or anti-tumor activity. Furthermore, the potential N-glycosylation site within HCDR1 was mutated in LYV377_VH-2Q, LYV377_VH-2A, and LYV377_VH-2Y (sequences also shown below; further mutations are in boldface and underlined).

```
>LYV377_VH-2
                          (SEQ ID NO: 11)
QVQLVESGGGLVQPGGSLKLSCATSGFNFNDSFMNWV

RQASGKGLEWVGQIRNKNYNYATYYTESLEGRVTISR
```

-continued

```
DDSKNTAYLQMNSLKTEDTAVYYCTSYYYDGFADYFD

YWGQGTTVTVSS

>LYV377_VH-2Q
                          (SEQ ID NO: 12)
QVQLVESGGGLVQPGGSLKLSCATSGFNFQDSFMNWV

RQASGKGLEWVGQIRNKNYNYATYYTESLEGRVTISR

DDSKNTAYLQMNSLKTEDTAVYYCTSYYYDGFADYFD

YWGQGTTVTVSS

>LYV377_VH-2A
                          (SEQ ID NO: 13)
QVQLVESGGGLVQPGGSLKLSCATSGFNFNDAFMNWV

RQASGKGLEWVGQIRNKNYNYATYYTESLEGRVTISR
```

-continued

```
DDSKNTAYLQMNSLKTEDTAVYYCTSYYYDGFADYFD

YWGQGTTVTVSS

>LYV377_VH-2Y
                          (SEQ ID NO: 14)
QVQLVESGGGLVQPGGSLKLSCATSGFNFNDYFMNWV

RQASGKGLEWVGQIRNKNYNYATYYTESLEGRVTISR

DDSKNTAYLQMNSLKTEDTAVYYCTSYYYDGFADYFD

YWGQGTTVTVSS
```

Recombinant full-length human IgG/kappa of humanized LYV377 antibodies were constructed. The humanized LYV377 antibodies include:

TM550 (CDR grafted humanized antibody derived from LYV377)

TM553 (including a heavy chain of VH-2/IgG2 and a light chain of VL-1/kappa),

LP3771 (including a heavy chain of VH-2/IgG1 and a light chain of VL-1/kappa),

LP3772 (including a heavy chain of VH-2/IgG4 and a light chain of VL-1/kappa),

LP3773 (including a heavy chain of VH-2/IgG1mut and a light chain of VL-1/kappa), TM738 (including a heavy chain of VH-2Q/IgG1mut and a light chain of VL-1/kappa), TM739 (including a heavy chain of VH-2A/IgG1mut and a light chain of VL-1/kappa), TM740 (including a heavy chain of VH-2Y/IgG1mut and a light chain of VL-1/kappa), and Ly181 (including a heavy chain of VH-2Y/IgG2 and a light chain of VL-1/kappa).

The amino acid sequences of the heavy chain and light chains of chimeric antibody TM377 and the humanized anti-CD40 antibodies derived from LYV377 listed above are provided below:

```
TM377
Heavy chain (SEQ id NO:  76):
EVQILETGGGLVKPGGSLRLSCATSGFNFNDSFMNWVRQAPGKGLEWVAQIRNKNYNYATYYTESLEGR

VTISRDDSKSRVYLQVSSLRAEDSAVYYCTSYYYDGFADYFDYWGQGVMVTVSSASTKGPSVFPLAPCS

RSTSESTAALGCLVKDYFPEPVTVSWNSGALTSGVHTFPAVLQSSGLYSLSSVVTVPSSSLGTKTYTCN

VDHKPSNTKVDKRVESKYGPPCPPCPAPEFLGGPSVFLFPPKPKDTLMISRTPEVTCVVVDVSQEDPEV

QFNWYVDGVEVHNAKTKPREEQFNSTYRVVSVLTVLHQDWLNGKEYKCKVSNKGLPSSIEKTISKAKGQ

PREPQVYTLPPSQEEMTKNQVSLTCLVKGFYPSDIAVEWESNGQPENNYKTTPPVLDSDGSFFLYSRLT

VDKSRWQEGNVFSCSVMHEALHNHYTQKSLSLSLG

Light chain (SEQ id NO: 77):
DIKMTQSPSFLSASVGDSVTFTCKASQNIYIYLNWYQQKFGEAPKLLIYNTNNLQTGIPSRFSGSESGT

VFTLTISSLQPEDVATYFCLQHSSRRTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGEC

TM550 Heavy chain (SEQ id NO: 78):
EVQLVESGGGLVQPGGSLKLSCAASGFNFNDSFMNWVRQASGKGLEWVGQIRNKNYNYATYYTESLEGR

FTISRDDSKNTAYLQMNSLKTEDTAVYYCTRYYYDGFADYFDYWGQGTTVTVSSASTKGPSVFPLAPCS

RSTSESTAALGCLVKDYFPEPVTVSWNSGALTSGVHTFPAVLQSSGLYSLSSVVTVPSSNFGTQTYTCN

VDHKPSNTKVDKTVERKCCVECPPCPAPPVAGPSVFLFPPKPKDTLMISRTPEVTCVVVDVSHEDPEVQ

FNWYVDGVEVHNAKTKPREEQFNSTFRVVSVLTVVHQDWLNGKEYKCKVSNKGLPAPIEKTISKTKGQP

REPQVYTLPPSREEMTKNQVSLTCLVKGFYPSDIAVEWESNGQPENNYKTTPPMLDSDGSFFLYSKLTV

DKSRWQQGNVFSCSVMHEALHNHYTQKSLSLSPG

TM553 Heavy chain (SEQ id NO: 79):
QVQLVESGGGLVQPGGSLKLSCATSGFNFNDSFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPCS

RSTSESTAALGCLVKDYFPEPVTVSWNSGALTSGVHTFPAVLQSSGLYSLSSVVTVPSSNFGTQTYTCN

VDHKPSNTKVDKTVERKCCVECPPCPAPPVAGPSVFLFPPKPKDTLMISRTPEVTCVVVDVSHEDPEVQ

FNWYVDGVEVHNAKTKPREEQFNSTFRVVSVLTVVHQDWLNGKEYKCKVSNKGLPAPIEKTISKTKGQP

REPQVYTLPPSREEMTKNQVSLTCLVKGFYPSDIAVEWESNGQPENNYKTTPPMLDSDGSFFLYSKLTV

DKSRWQQGNVFSCSVMHEALHNHYTQKSLSLSPG

LP3771 Heavy chain (SEQ id NO: 80):
QVQLVESGGGLVQPGGSLKLSCATSGFNFNDSFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPSS

KSTSGGTAALGCLVKDYFPEPVTVSWNSGALTSGVHTFPAVLQSSGLYSLSSVVTVPSSSLGTQTYICN

VNHKPSNTKVDKKVEPKSCDKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYKCKVSNKALPAPIEKTISKA

KGQPREPQVYTLPPSREEMTKNQVSLTCLVKGFYPSDIAVEWESNGQPENNYKTTPPVLDSDGSFFLYS

KLTVDKSRWQQGNVFSCSVMHEALHNHYTQKSLSLSPG
```

-continued

LP3772 Heavy chain (SEQ id NO: 81):
QVQLVESGGGLVQPGGSLKLSCATSGFNFNDSFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPCS

RSTSESTAALGCLVKDYFPEPVTVSWNSGALTSGVHTFPAVLQSSGLYSLSSVVTVPSSSLGTKTYTCN

VDHKPSNTKVDKRVESKYGPPCPPCPAPEFLGGPSVFLFPPKPKDTLMISRTPEVTCVVVDVSQEDPEV

QFNWYVDGVEVHNAKTKPREEQFNSTYRVVSVLTVLHQDWLNGKEYKCKVSNKGLPSSIEKTISKAKGQ

PREPQVYTLPPSQEEMTKNQVSLTCLVKGFYPSDIAVEWESNGQPENNYKTTPPVLDSDGSFFLYSRLT

VDKSRWQEGNVFSCSVMHEALHNHYTQKSLSLSLG

LP3773 Heavy chain (SEQ id NO: 82):
QVQLVESGGGLVQPGGSLKLSCATSGFNFNDSFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPSS

KSTSGGTAALGCLVKDYFPEPVTVSWNSGALTSGVHTFPAVLQSSGLYSLSSVVTVPSSSLGTQTYICN

VNHKPSNTKVDKKVEPKSCDKTHTCPPCPAPELLGPSVFLFPPKPKDTLMISRTPEVTCVVVDVEHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSK

LTVDKSRWQQGNVFSCSVMHEALHNHYTQKSLSLSPG

TM738 Heavy Chain (SEQ id NO: 83):
QVQLVESGGGLVQPGGSLKLSCATSGFNFQDSFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPSS

KSTSGGTAALGCLVKDYFPEPVTVSWNSGALTSGVHTFPAVLQSSGLYSLSSVVTVPSSSLGTQTYICN

VNHKPSNTKVDKKVEPKSCDKTHTCPPCPAPELLGPSVFLFPPKPKDTLMISRTPEVTCVVVDVEHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSK

LTVDKSRWQQGNVFSCSVMHEALHNHYTQKSLSLSPG

TM739 Heavy Chain (SEQ id NO: 84):
QVQLVESGGGLVQPGGSLKLSCATSGFNFNDAFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPSS

KSTSGGTAALGCLVKDYFPEPVTVSWNSGALTSGVHTFPAVLQSSGLYSLSSVVTVPSSSLGTQTYICN

VNHKPSNTKVDKKVEPKSCDKTHTCPPCPAPELLGPSVFLFPPKPKDTLMISRTPEVTCVVVDVEHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSK

LTVDKSRWQQGNVFSCSVMHEALHNHYTQKSLSLSPG

TM740 Heavy Chain (SEQ id NO: 85):
QVQLVESGGGLVQPGGSLKLSCATSGFNFNDYFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPSS

KSTSGGTAALGCLVKDYFPEPVTVSWNSGALTSGVHTFPAVLQSSGLYSLSSVVTVPSSSLGTQTYICN

VNHKPSNTKVDKKVEPKSCDKTHTCPPCPAPELLGPSVFLFPPKPKDTLMISRTPEVTCVVVDVEHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSK

LTVDKSRWQQGNVFSCSVMHEALHNHYTQKSLSLSPG

Ly 181 Heavy Chain (SEQ id NO: 86):
QVQLVESGGGLVQPGGSLKLSCATSGFNFNDYFMNWVRQASGKGLEWVGQIRNKNYNYATYYTESLEGR

VTISRDDSKNTAYLQMNSLKTEDTAVYYCTSYYYDGFADYFDYWGQGTTVTVSSASTKGPSVFPLAPCS

-continued

RSTSESTAALGCLVKDYFPEPVTVSWNSGALTSGVHTFPAVLQSSGLYSLSSVVTVPSSNFGTQTYTCN

VDHKPSNTKVDKTVERKCCVECPPCPAPPVAGPSVFLFPPKPKDTLMISRTPEVTCVVVDVSHEDPEVQ

FNWYVDGVEVHNAKTKPREEQFNSTFRVVSVLTVVHQDWLNGKEYKCKVSNKGLPAPIEKTISKTKGQP

All of the above-noted anti-CD40 humanized antibodies share the following common light chain (human kappa chain):

```
Common Light chain
(SEQ id NO: 87):
DIQMTQSPSSLSASVGDRVTITCKASQNIYIYLN

WYQQKPGKAPKLLIYNTNNLQTGVPSRFSGSGSG

TDFTLTISSLQPEDFATYYCLQHSSRRTFGGGTK

VEIKRTVAAPSVFIFPPSDEQLKSGTASVVCLLN

NFYPREAKVQWKVDNALQSGNSQESVTEQDSKDS

TYSLSSTLTLSKADYEKHKVYACEVTHQGLSSPV

TKSFNRGEC
```

These humanized antibodies, along with the chimeric antibody TM377 (including a heavy chain of LYV377 VH/human IgG4 and a light chain of LYV377 VL/kappa), were expressed in HEK293 cells or CHO cells and the antibodies were purified from the cell culture following conventional methods. The purified antibodies were examined for endotoxin (<5 EU/mg) and monomerization (>95%).

(ii) Humanized Anti-CD40 Antibodies Derived from LYV378

The VH and VL sequences of murine LYV378 are provided below (CDR regions in boldface as identified using the Kabat CDR definitions):

```
>LYV378_VH
                                (SEQ ID NO: 88)
EVHLVESGGGLVQPGRSLKLSCAASGFTFTNYGLHWI

RQAPTKGLEWVASISPSGGVTYYRDSVKGRFTISRDN

GKTTLHLQMDSLRSEDTATYYCALPFLGWGGANWIAH

WGQGTLVTVSS

>LYV378_VL
                                (SEQ ID NO: 89)
DIQMTQSPASLSASLGETVSIECLASEDISNDLAWYQ

QKSGKSPQLLIYFVDRLLDGVPSRFSGSGSGTRHSLK

ISGMQPEDEADYFCQQSYKYPPTFGGGTKLELKR
```

Sequence alignments were performed to compare the LYV378 VH and VL to human germline VH and VL sequences, respectively, following methods known in the art. See, e.g., Glanville J. et al. PNAS 2009; 106 (48) 20216-21. Based on overall sequence identity, matching interface positions and similarly classed CDR canonical positions, a germline family was identified for each of the light and heavy chains as the desired acceptor frameworks, i.e., IGKV1-39*01 for the light chain and IGHV3-23*04 for the heavy chain. Human acceptors were identified as CAG17622.1 immunoglobulin kappa light chain and AAF75634.1 immunoglobulin heavy chain variable region, the amino acid sequences of which are shown below:

```
>AAF75634.1 Human VH Acceptor
                                (SEQ ID NO: 90)
EVQLVESGGGLVQPGGSLRLSCAASGFTFSSYAMSWV

RQAPGKGLEWVSAISGSGGSTYYADSVKGRFTISRDN

SKNTLYLQMNSLRAEDTAVYYCAKRPTLGATGYWGQG

TLVTVSS

>CAG17622.1 Human VL Acceptor
                                (SEQ ID NO: 91)
DIQMTQSPSSLSASVGDRVTITCRASQSISSYLNWYQ

QKPGKAPKLLIYAASSLQSGVPSRFSGSGSGTDFTLT

ISSLQPEDFATYYCQOSYSTPPRTFGQGTKLEIKRT
```

The CDRs of the parent LYV378 antibody were grafted into the corresponding CDR regions of the above-noted human VH and VL acceptor sequences to generate humanized LYV378_VH-1 and LYV378_VL-1 chains (grafted humanized antibody), the amino acid sequence of each of which is provided below (CDRs in boldface):

```
>LYV378_VH-1 (grafted LYV378_VH, SEQ ID NO: 22)
EVQLVESGGGLVQPGGSLRLSCAASGFTFTNYGLHWVRQAPGKGLEWVS

SISPSGGVTYYRDSVKGRFTISRDNSKNTLYLQMNSLRAEDTAVYYCAK

PFLGWGGANWIAHWGQGTLVTVSS

>LYV378_VL-1 (grafted LYV378_VL; SEQ ID NO: 23)
DIQMTQSPSSLSASVGDRVTITCLASEDISNDLAWYQQKPGKAPKLLIY

FVDRLLDGVPSRFSGSGSGTDFTLTISSLQPEDFATYYCQQSYKYPPTF

GQGTKLEIKR
```

Recombinant full human IgG/kappa of humanized LYV378 antibodies were constructed. The humanized LYV378 antibodies include:

TM559 (including a heavy chain of LYV378_VH-1/IgG2 and a light chain of LYV378_VL-1/kappa), LP3781 (including a heavy chain of LYV378_VH-1/IgG1 and a light chain of LYV378_VL-1/kappa), LP3782 (including a heavy chain of LYV378_VH-1/IgG4 and a light chain of LYV378_VL-1/kappa), and LP3783 (including a heavy chain of LYV378_VH-1/ IgG1mut and a light chain of LYV378_VL-1/kappa).

The amino acid sequences of the heavy chain and light chain of the chimeric antibody TM378 (IgG4) and the anti-CD40 humanized antibodies derived from LYV378 listed above are provided below:

```
TM378
Heavy chain (SEQ ID NO: 92):
EVHLVESGGGLVQPGRSLKLSCAASGFTFTNYGLHWIRQAPTKGLEWVA

SISPSGGVTYYRDSVKGRFTISRDNGKTTLHLQMDSLRSEDTATYYCAL

PFLGWGGANWIAHWGQGTLVTVSSASTKGPSVFPLAPCSRSTSESTAAL

GCLVKDYFPEPVTVSWNSGALTSGVHTFPAVLQSSGLYSLSSVVTVPSS
```

-continued

SLGTKTYTCNVDHKPSNTKVDKRVESKYGPPCPPCPAPEFLGGPSVFLF

PPKPKDTLMISRTPEVTCVVVDVSQEDPEVQFNWYVDGVEVHNAKTKPR

EEQFNSTYRVVSVLTVLHQDWLNGKEYKCKVSNKGLPSSIEKTISKAKG

QPREPQVYTLPPSQEEMTKNQVSLTCLVKGFYPSDIAVEWESNGQPENN

YKTTPPVLDSDGSFFLYSRLTVDKSRWQEGNVFSCSVMHEALHNHYTQK

SLSLSLG

Light Chain (SEQ ID NO: 93):
DIQMTQSPASLSASLGETVSIECLASEDISNDLAWYQQKSGKSPQLLIY

FVDRLLDGVPSRFSGSGSGTRHSLKISGMQPEDEADYFCQQSYKYPPTF

GGGTKLELKRTVAAPSVFIFPPSDEQLKSGTASVVCLLNNFYPREAKVQ

WKVDNALQSGNSQESVTEQDSKDSTYSLSSTLTLSKADYEKHKVYACEV

THQGLSSPVTKSFNRGEC

TM559 Heavy Chain ((SEQ ID NO: 94):
EVQLVESGGGLVQPGGSLRLSCAASGFTFTNYGLHWVRQAPGKGLEWVS

SISPSGGVTYYRDSVKGRFTISRDNSKNTLYLQMNSLRAEDTAVYYCAK

PFLGWGGANWIAHWGQGTLVTVSSASTKGPSVFPLAPCSRSTSESTAAL

GCLVKDYFPEPVTVSWNSGALTSGVHTFPAVLQSSGLYSLSSVVTVPSS

NFGTQTYTCNVDHKPSNTKVDKTVERKCCVECPPCPAPPVAGPSVFLFP

PKPKDTLMISRTPEVTCVVVDVSHEDPEVQFNWYVDGVEVHNAKTKPRE

EQFNSTFRVVSVLTVVHQDWLNGKEYKCKVSNKGLPAPIEKTISKTKGQ

PREPQVYTLPPSREEMTKNQVSLTCLVKGFYPSDIAVEWESNGQPENNY

KTTPPMLDSDGSFFLYSKLTVDKSRWQQGNVFSCSVMHEALHNHYTQKS

LSLSPG

LP3781 Heavy Chain (SEQ ID NO: 95):
EVQLVESGGGLVQPGGSLRLSCAASGFTFTNYGLHWVRQAPGKGLEWVS

SISPSGGVTYYRDSVKGRFTISRDNSKNTLYLQMNSLRAEDTAVYYCAK

PFLGWGGANWIAHWGQGTLVTVSSASTKGPSVFPLAPSSKSTSGGTAAL

GCLVKDYFPEPVTVSWNSGALTSGVHTFPAVLQSSGLYSLSSVVTVPSS

SLGTQTYICNVNHKPSNTKVDKKVEPKSCDKTHTCPPCPAPELLGGPSV

FLFPPKPKDTLMISRTPEVTCVVVDVSHEDPEVKFNWYVDGVEVHNAKT

KPREEQYNSTYRVVSVLTVLHQDWLNGKEYKCKVSNKALPAPIEKTISK

AKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHY

TQKSLSLSPG

LP3782 Heavy Chain (SEQ ID NO: 96):
EVQLVESGGGLVQPGGSLRLSCAASGFTFTNYGLHWVRQAPGKGLEWVS

SISPSGGVTYYRDSVKGRFTISRDNSKNTLYLQMNSLRAEDTAVYYCAK

PFLGWGGANWIAHWGQGTLVTVSSASTKGPSVFPLAPCSRSTSESTAAL

GCLVKDYFPEPVTVSWNSGALTSGVHTFPAVLQSSGLYSLSSVVTVPSS

SLGTKTYTCNVDHKPSNTKVDKRVESKYGPPCPPCPAPEFLGGPSVFLF

PPKPKDTLMISRTPEVTCVVVDVSQEDPEVQFNWYVDGVEVHNAKTKPR

EEQFNSTYRVVSVLTVLHQDWLNGKEYKCKVSNKGLPSSIEKTISKAKG

QPREPQVYTLPPSQEEMTKNQVSLTCLVKGFYPSDIAVEWESNGQPENN

-continued

YKTTPPVLDSDGSFFLYSRLTVDKSRWQEGNVFSCSVMHEALHNHYTQK

SLSLSLG

LP3783 Heavy Chain (SEQ ID NO: 97):
EVQLVESGGGLVQPGGSLRLSCAASGFTFTNYGLHWVRQAPGKGLEWVS

SISPSGGVTYYRDSVKGRFTISRDNSKNTLYLQMNSLRAEDTAVYYCAK

PFLGWGGANWIAHWGQGTLVTVSSASTKGPSVFPLAPSSKSTSGGTAAL

GCLVKDYFPEPVTVSWNSGALTSGVHTFPAVLQSSGLYSLSSVVTVPSS

SLGTQTYICNVNHKPSNTKVDKKVEPKSCDKTHTCPPCPAPELLGGPSVF

LFPPKPKDTLMISRTPEVTCVVVDVEHEDPEVKFNWYVDGVEVHNAKTK

PREEQYNSTYRVVSVLTVLHQDWLNGKEYKCKVSNKALPAPIEKTISKA

KGQPREPQVYTLPPSREEMTKNQVSLTCLVKGFYPSDIAVEWESNGQPE

NNYKTTPPVLDSDGSFFLYSKLTVDKSRWQQGNVFSCSVMHEALHNHYT

QKSLSLSPG

Humanized anti-CD40 antibodies TM559, LP3781, LP3782, and LP3783 share the following common light chain:

Common Light Chain (SEQ ID NO: 98):
DIQMTQSPSSLSASVGDRVTITCLASEDISNDLAWYQQKPGKAPKLLIY

FVDRLLDGVPSRFSGSGSGTDFTLTISSLQPEDFATYYCQQSYKYPPTF

GQGTKLEIKRTVAAPSVFIFPPSDEQLKSGTASVVCLLNNFYPREAKVQ

WKVDNALQSGNSQESVTEQDSKDSTYSLSSTLTLSKADYEKHKVYACEV

THQGLSSPVTKSFNRGEC

Amino acid sequences of the heavy chains and light chains of the anti-CD40 Ly253 antibodies are provided below (CDRs in foldface):

Ly253-G4 Heavy Chain (SEQ ID NO: 99):
QVQLVQSGAEVKKPGASVKVSCKASGYTFTGYYMHWVRQAPGQGLEWMG

WINPDSGGTNYAQKFQGRVTMTRDTSISTAYMELNRLRSDDTAVYYCAR

DQPLGYCTNGVCSYFDYWGQGTLVTVSSASTKGPSVFPLAPCSRSTSES

TAALGCLVKDYFPEPVTVSWNSGALTSGVHTFPAVLQSSGLYSLSSVVT

VPSSSLGTKTYTCNVDHKPSNTKVDKRVESKYGPPCPPCPAPEFLGGPS

VFLFPPKPKDTLMISRTPEVTCVVVDVSQEDPEVQFNWYVDGVEVHNAK

TKPREEQFNSTYRVVSVLTVLHQDWLNGKEYKCKVSNKGLPSSIEKTIS

KAKGQPREPQVYTLPPSQEEMTKNQVSLTCLVKGFYPSDIAVEWESNGQ

PENNYKTTPPVLDSDGSFFLYSRLTVDKSRWQEGNVFSCSVMHEALHNH

YTQKSLSLSLG

Ly253-G2 Heavy Chain (SEQ ID NO: 100):
QVQLVQSGAEVKKPGASVKVSCKASGYTFTGYYMHWVRQAPGQGLEWMG

WINPDSGGTNYAQKFQGRVTMTRDTSISTAYMELNRLRSDDTAVYYCAR

DQPLGYCTNGVCSYFDYWGQGTLVTVSSASTKGPSVFPLAPCSRSTSES

TAALGCLVKDYFPEPVTVSWNSGALTSGVHTFPAVLQSSGLYSLSSVVT

VPSSNFGTQTYTCNVDHKPSNTKVDKTVERKCCVECPPCPAPPVAGPSV

-continued

FLFPPKPKDTLMISRTPEVTCVVVDVSHEDPEVQFNWYVDGVEVHNAKT

KPREEQFNSTFRVVSVLTVVHQDWLNGKEYKCKVSNKGLPAPIEKTISK

TKGQPREPQVYTLPPSREEMTKNQVSLTCLVKGFYPSDIAVEWESNGQP

ENNYKTTPPMLDSDGSFFLYSKLTVDKSRWQQGNVFSCSVMHEALHNHY

TQKSLSLSPG

Ly253-G4 and Ly253-G2 share the following common
light chain (SEQ ID NO: 101):
DIQMTQSPSSVSASVGDRVTITCRASQGIYSWLAWYQQKPGKAPNLLIY

TASTLQSGVPSRFSGSGSGTDFTLTISSLQPEDFATYYCQQANIFPLTF

GGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEV

THQGLSSPVTKSFNRGEC

These humanized antibodies, along with the chimeric antibody TM378 (human IgG4), were expressed in HEK293 cells or CHO cells and purified from the cell culture via protein A affinity chromatography for further analysis. The purified antibodies were examined for endotoxin (<5 EU/mg) and monomerization (>95%).

Example 2: Evaluation of Anti-CD40 Antibodies

CD40 Binding FACS

FACS analysis was performed to evaluate the binding properties of exemplary anti-CD40 antibodies. Briefly, CHO cells over-expressing human CD40 were harvested using trypsin-EDTA partial digestion followed by centrifugation at 1000 g for 3 minutes. The cells were re-suspended in cold PBS-BSA (2%) at $2 \times 10^6$/mL and aliquoted to 100 µL/tube. The anti-CD40 antibodies were diluted in PBS-BSA (final concentrations were 0.01, 0.1, 1, and 10 µg/mL) and 50 µL of each was added to the CHO-CD40 cells. The cell solutions were mixed and incubated at 4° C. in the dark for 2 hours. The cells were then washed with PBS-BSA twice. Secondary antibody conjugates (goat F(ab') 2 anti-human IgG-Fc (PE), pre-adsorbed, Abcam #ab98596) at 1/500 dilution and 100 µL/well was added and the cells were mixed and incubated 4° C. in dark for 1 hour. The cells were then washed twice with PBS-BSA, followed by fixation in 2% PFA/PBS, and were then subjected to FACS analysis.

Figures 1A, 1B:
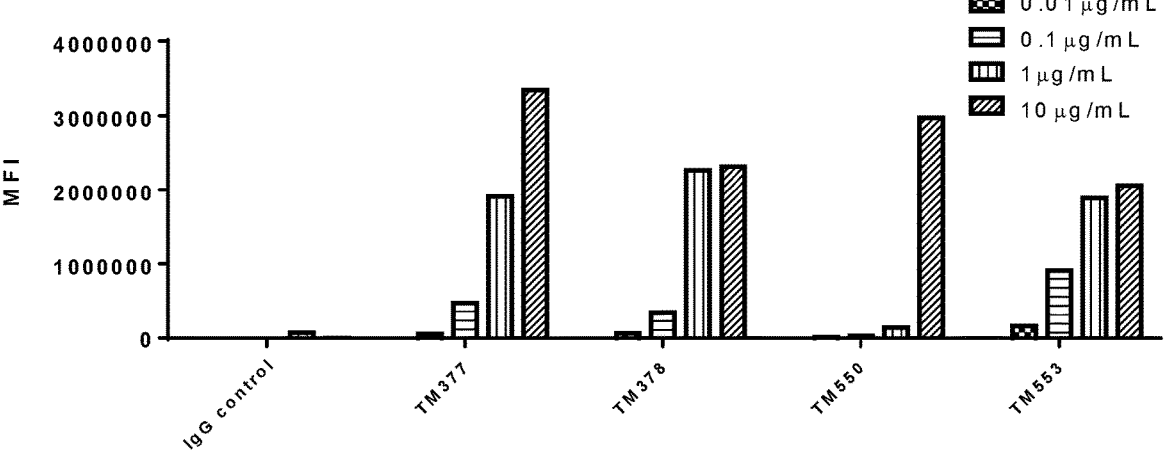
FIGS. 1A-1F are charts showing binding activity of anti-CD40 antibodies as indicated on the x-axis to human CD40 expressed on CHO cells. The bars ("IgG control" and "2nd") served as controls. Binding of these anti-CD40 antibodies are indicated by the mean fluorescence intensity (MFI) on the y-axis. 1A: clones TM377, TM378, TM550 and TM553 at various concentrations as indicated. 1B: Clone TM559 at various concentrations as indicated. 1C: Clones TM738, TM739, TM740, and TM553 at various concentrations as indicated. 1D: Clone Ly181 and TM740 at various concentrations as indicated. 1E: Clones LP3771, LP3772, LP3773, LP3781, LP3782, and LP3783 at various concentrations as indicated. 1F: Clones TM377, Ly253-G4, and Ly253-G2 at various concentrations as indicated.
Figures 1C, 1D:
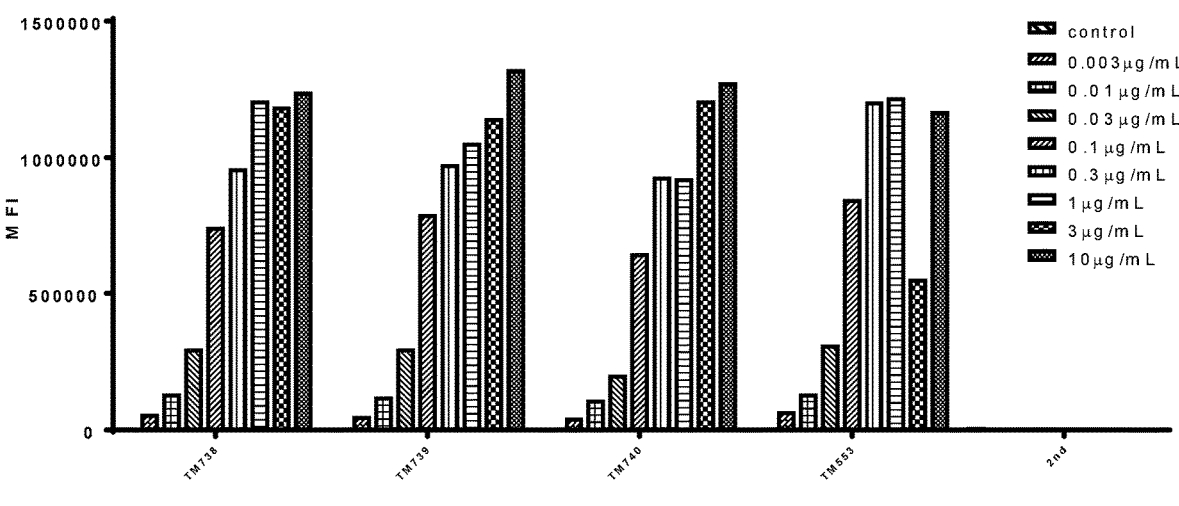
Figure 1E:
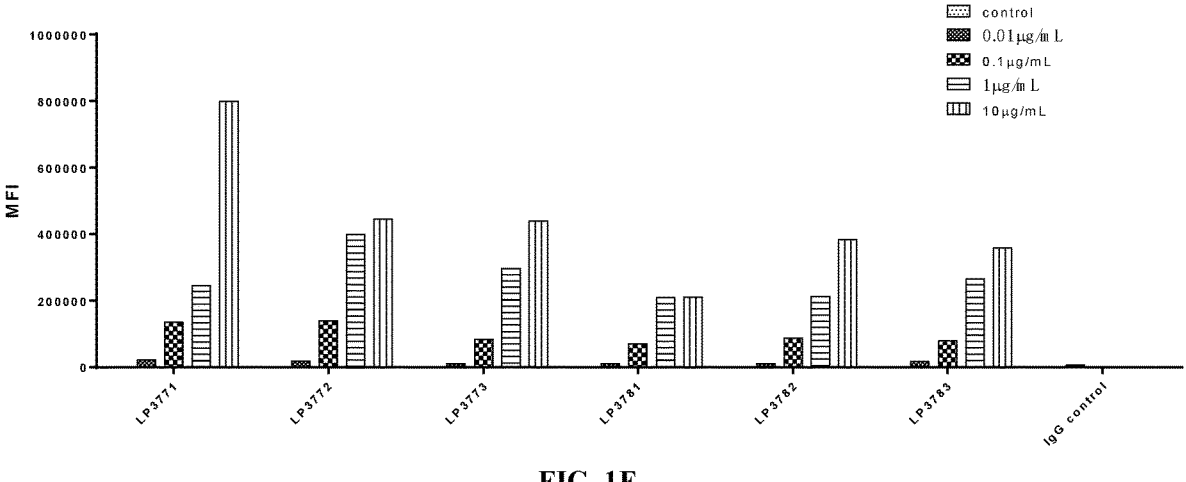

As shown in FIG. 1A, the CDR grafted 377 humanized antibody TM550 showed reduced binding activity as compared to the chimeric parent TM377 and the humanized antibodies with back mutations (TM553 having the VH-2 chain) exhibited comparable binding to cellular CD40 as relative to the TM377 parent. Humanized antibodies TM738, TM739, TM740 and Ly181, having mutations to remove potential N-glycosylation sites, showed comparable CD40 binding activity relative to TM553 (FIG. 1C and FIG. 1D). The humanized IgG antibodies LP3771 (human IgG1), LP3772 (human IgG4) and LP3773 (human IgG1mutant) showed similar CD40 binding activity relative to TM553 (human IgG2) (FIG. 1E and FIG. 1F).

The TM559 humanized antibody, derived from LYV378, exhibited similar cellular CD40 binding activity to its chimeric counterpart TM378 (FIG. 1A and FIG. 1B). Furthermore, the humanized IgG antibodies derived from LYV378, including LP3781 (human IgG1), LP3782 (human IgG4) and LP3783 (human IgG1mutant), showed similar CD40 binding activity to TM559 (human IgG2) (FIG. 1B and FIG. 1E).

Figure 1F:
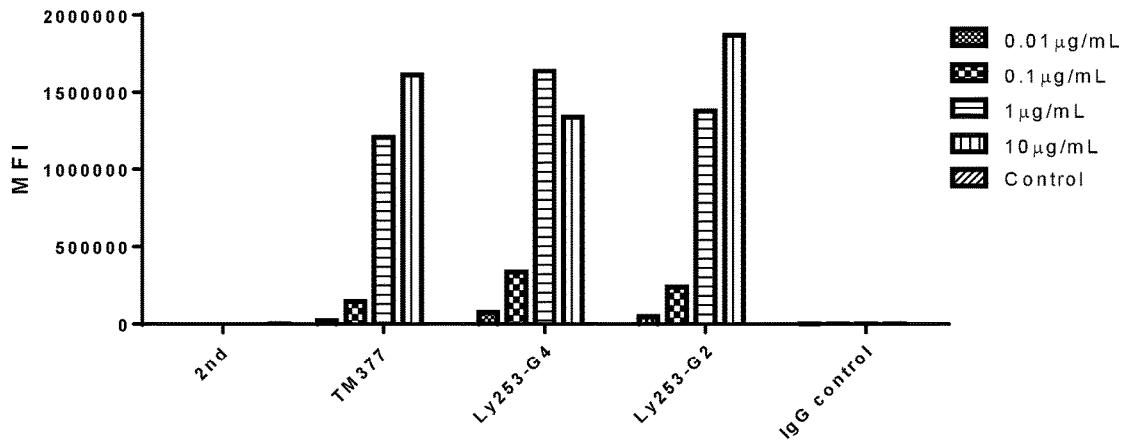
Figure 2A:
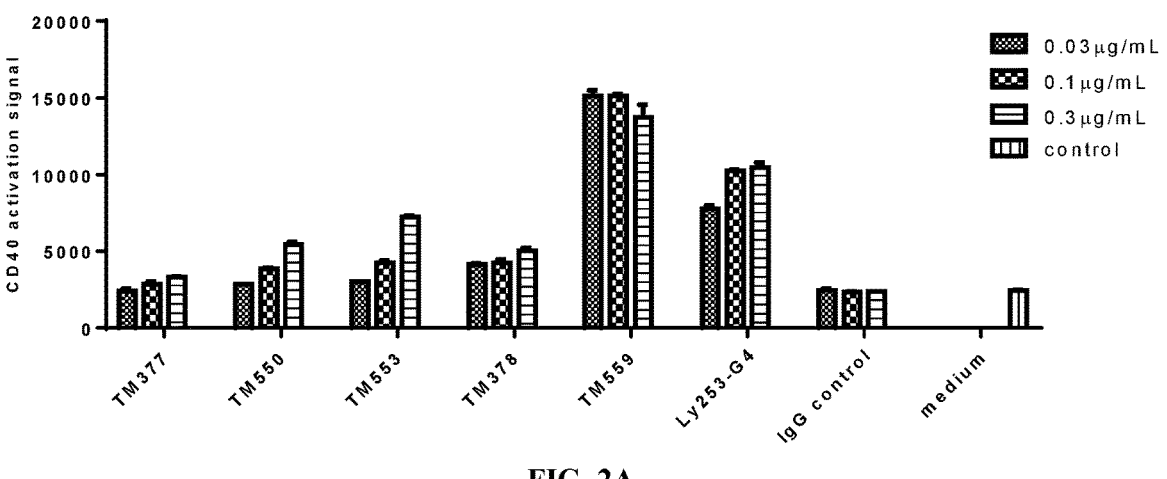
FIGS. 2A-2D are charts showing stimulation of human CD40 activation as indicated by IL8 secretion in a reporter assay by a number of anti-CD40 antibodies. The various antibodies are indicated on the x-axis, and the CD40 activation signal are indicated on the y-axis. 2A: Clones TM377, TM550, TM553, TM378, TM559, and Ly253-G4 at various concentrations as indicated. 2B: Clones TM553, LP3771, LP3772, LP3773, Ly253-G4, Ly253-G2, TM559, LP3781, LP3782, and LP3783 at various concentrations as indicated. 2C: Clones TM738, TM739, TM740, LP3773, and Ly253-G2 at various concentrations as indicated. 2D: Clones Ly181, TM740, LP3783, and Ly253-G2 at various concentrations as indicated.
Figure 2B:
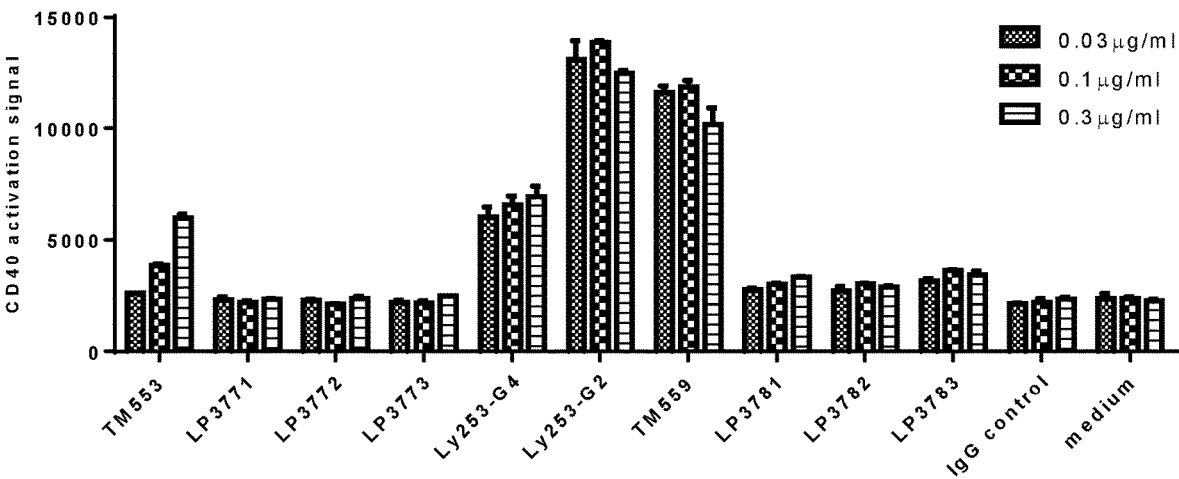
Figure 2C:
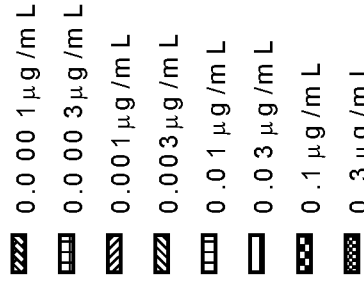
Figure 2D:
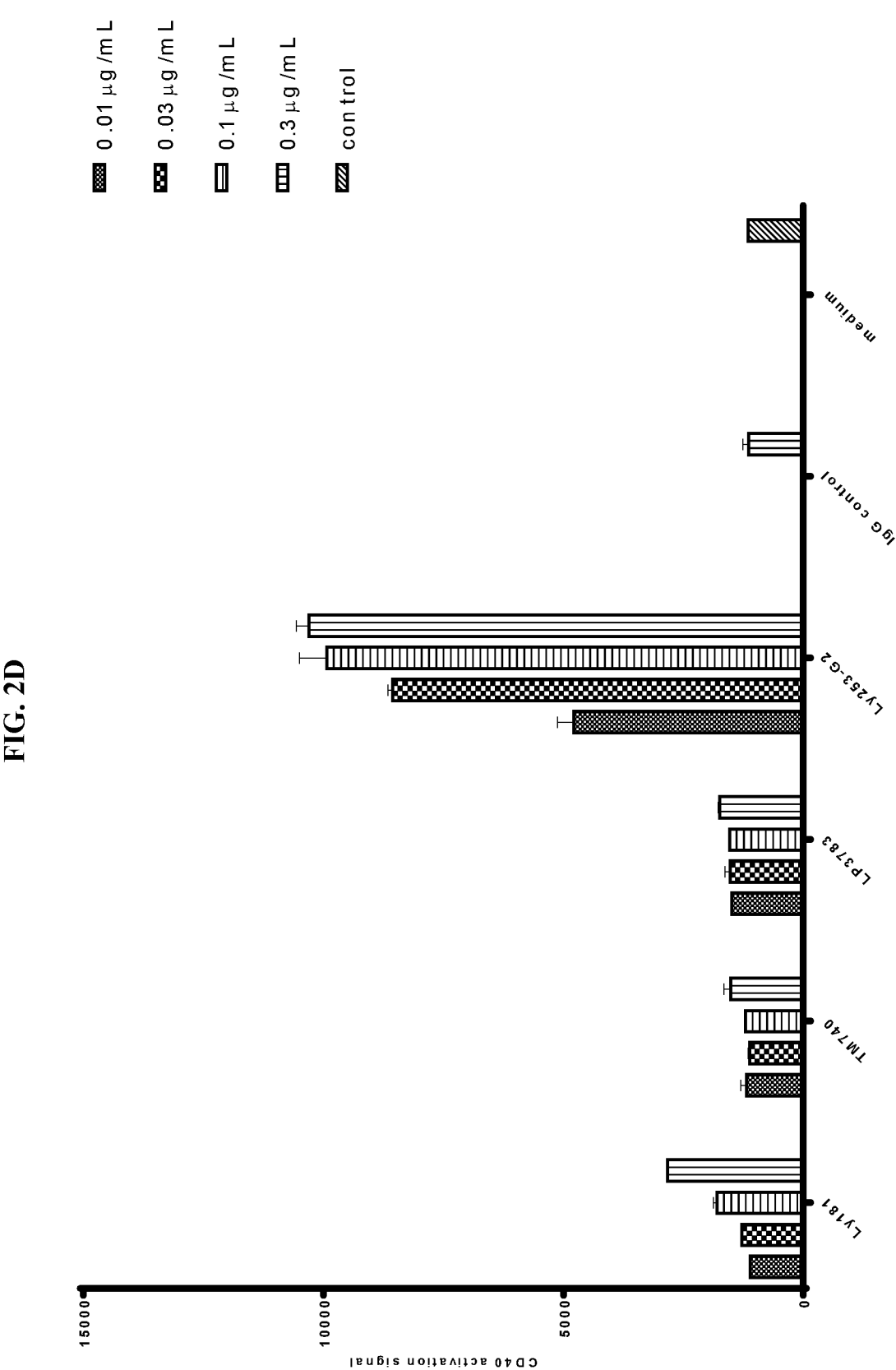

Additional CD40 antibodies Ly253-G4, Ly253-G2 showed similar CD40 binding activity relative to TM377 (FIG. 1F).

CD40 Reporter Assay

To determine the agonist activity of these anti-CD40 antibodies, a CD40 reporter assay was developed, which involves reporter cells over-expressing human CD40. This GS-H2-huCD40 reporter cells were re-suspended and diluted to $1 \times 10^4$ cells/mL with assay buffer (MEM containing 1% FBS). The cells were added at 100 µL/well, such that the final cell number was 1000 cells/well in the assay plate (Nunc, Cat #167425). Samples were added at 100 µL/well test sample at 2× final concentrations to the assay plate. The assay plate was incubated in 37° C., 5% $CO_2$ incubator for 18-20 hours. After the 18-20 hour incubation, 8 µL of the supernatant from each well of the assay plate was collected and added to HTRF detection assay plate (Nunc). A Human Interleukin 8 (reporter of CD40 activation) detection assay was performed using a Human IL-8 Assay Kit (Cisbio, Cat #62IL8PEB). In particular, 16 µL assay volume was used. The results were read using Time Resolved Fluorescence by Tecan F200pro and the relative light unit data was recorded.

As shown in FIGS. 2A-2D, the anti-CD40 antibodies stimulated human CD40 activation in various degrees as evidenced by secretion levels of IL-8 in the reporter assays. The chimeric TM377 and the humanized antibodies derived from LYV377, including TM550, TM553, TM738, TM739, TM740, Ly181, LP3771, LP3772 and LP3773, showed weak activity in stimulating the CD40 reporter regardless of the IgG isotypes used in these humanized antibodies. The humanized antibody TM559 (IgG2), which was derived from LYV378, exhibited high CD40 agonist activity. The chimeric TM378 and humanized antibodies derived from LYV378, including TM3781 and TM3783 (both IgG1) and TM3782 (IgG4) showed low CD40 agonist activity. Antibody Ly253-G2 and Ly253-G4 showed CD40 agonist activity.

These three series of anti-CD40 antibodies showed different levels of CD40 agonist activity, although they showed similar binding activity to CD40. The magnitude of CD40 activation was further influenced by the Fc variants contained therein, likely attributable to the hinge flexibility of each antibody isotype structure.

Anti-Tumor Activity

Exemplary anti-CD40 antibodies were tested in mouse syngeneic tumor models in vivo to determine the anti-tumor efficacy and toxicity of these antibodies. Murine colon cancer MC38 tumor cells were subcutaneously implanted into homozygous human CD40 knock-in C57BL6 mice. Mice were grouped when the tumor size was approximately $150 \pm 50$ mm³ (n=6). Anti-CD40 antibodies were administered by intraperitoneal injections and tumor sizes were measure during 4-6 weeks of antibody treatment. Tumor sizes were calculated as tumor volume using formula of 0.5×length×width².

Figure 3:
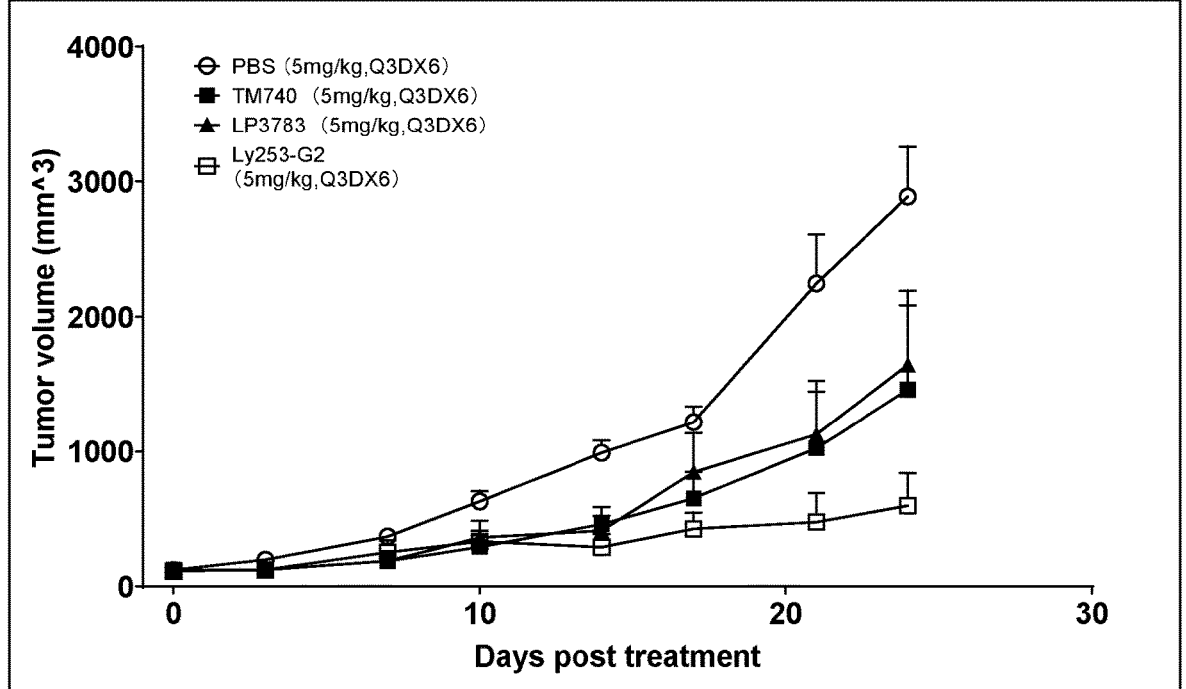
FIG. 3 is a chart showing anti-tumor activities of exemplary humanized anti-CD40 antibodies clones TM740, LP3783, and clone Ly253.
Figure 4A:
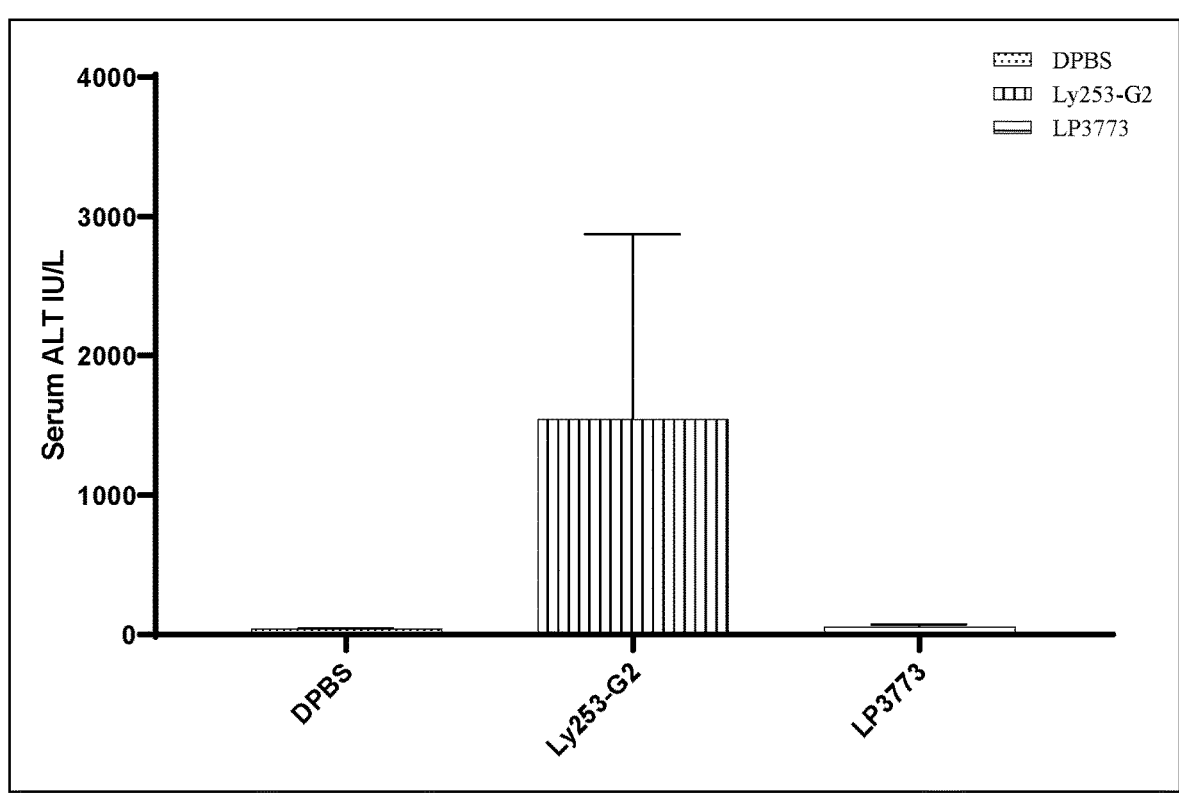
FIGS. 4A and 4B are charts showing serum alanine transaminase (ALT, a liver enzyme released into serum upon liver damage) level after treatment of humanized anti-CD40 antibodies as shown in human CD40 knock-in mouse syngeneic model inoculated with MC38 tumor cells.
Figure 4B:
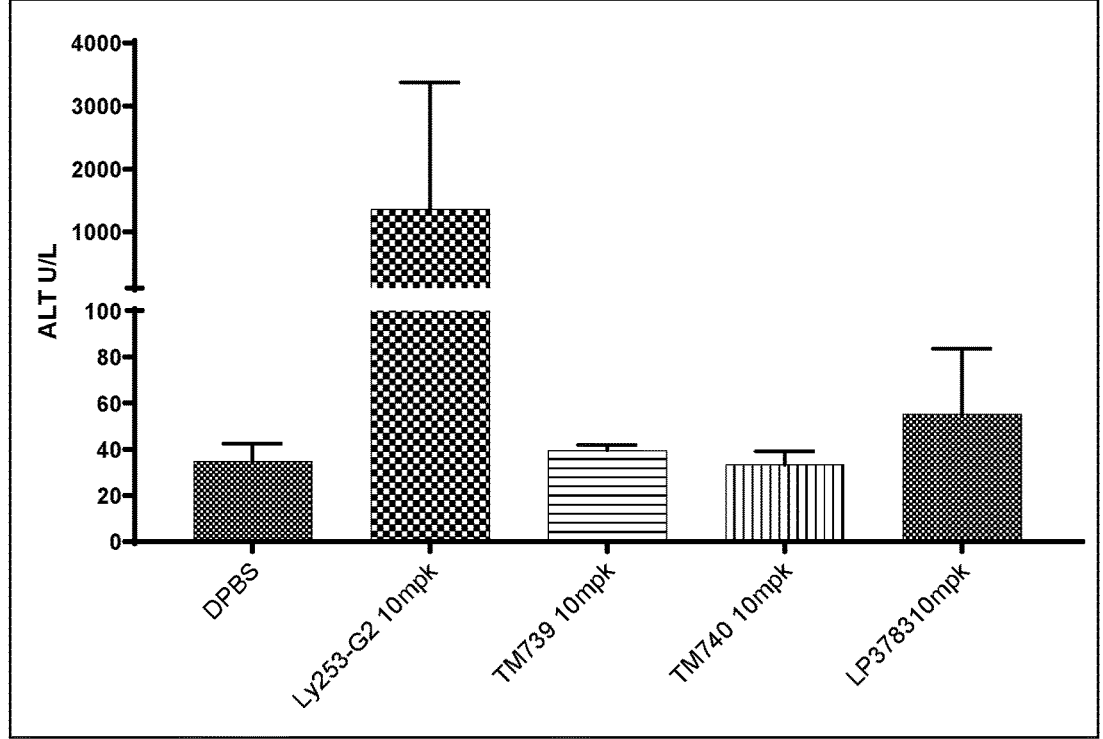

Anti-tumor efficacy was evaluated between tumor sizes of the control group and antibody treatment group as shown in FIG. 3. Exemplary clones TM740 and LP3783 showed lower efficacy relative to Ly253-G2 but still significant anti-tumor activities compared with negative control. Furthermore, LP3773, TM739, TM740 and LP3783 did not cause apparent elevation of serum ALT as compared with Ly253-G2 (FIGS. 4A and 4B).

Example 3: Bi-Specific Antibodies to CD40 and
PD-L1

Construction of Anti-PD-L1 Antibodies

Anti-human PD-L1 antibodies were generated using standard murine hybridoma technology. An exemplary anti-PD-L1 antibody, LYV5574 (hybridoma 30H8), was developed. The amino acid sequences of the antibody LYV5574 were analyzed and the CDRs 5 were identified following the Kabat CDR definitions. The VH and VL sequences of LYV5574 are provided below with the CDR regions identified in boldface:

```
>LYV5574_VH
                            ((SEQ ID NO: 102)
QVKLLQSGAALVKPGASVKMSCKTSGYTFTDFWMSWVKQSHGKSLEWVG

QIYPNTGTTHSNEKFKGKATLTVDKSTSTAYLELSRLTSEDSAIYYCSR

SYHISTTPNWFAYWGQGTLVTVSS

>LYV5574_VL
                            (SEQ ID NO: 103)
DIQMTQAPSLLSASVGDRVTLNCKASQNVYKKLEWYQQKHGEAPKVVIH

HTNILQTGISSRFSGSGSGTDYTLTISSLQSEDVATYYCYQWNSGPTFG

AGTKLELKR
```

LYV5574 was humanized following the descriptions in Example 1 above. The germline IGKV1-27*01 gene and IGHV1-46*01 gene were identified as the heavy and light chain acceptor framework, respectively. Human acceptors were then identified as >AAB48616.1 Ig kappa chain V-region and AAC18181.1 immunoglobulin heavy chain variable region.

The CDRs of the parent LYV5574 antibody were grafted into the corresponding CDR regions of the above-noted human VH and VL acceptor sequences to generate humanized LYV5574_VH-1 and LYV5574_VL-1 chains (grafted humanized antibody), the amino acid sequence of each of which is provided below (CDRs in boldface):

```
>LYV5574_VL-1 (grafted LYV5574_VL; SEQ ID NO: 31)
DIQMTQSPSSLSASVGDRVTITCKASQNVYKKLEWYQQKPGKVPKLLIY

HTNILQTGVPSRFSGSGSGTDFTLTISSLQPEDVATYYCYQWNSGPTFG

GGTKVEIKR

>LYV5574_VH-1 (grafted LYV5574_VH; SEQ ID NO: 30)
QVQLVQSGAEVKKPGASVKVSCKASGYTFTDFWMSWVRQAPGQGLEWMG

QIYPNTGTTHSNEKFKGRVTMTRDTSTSTVYMELSSLRSEDTAVYYCAR

SYHISTTPNWFAYWGQGTLVTVSS
```

Homology modeling of the Fv fragment of LYV5574 was carried out. The VH and VL sequences of LYV5574 were BLAST searched against PDB antibody database for identifying the best templates for Fv fragments and especially for building the domain interface. Structural template 1JV5 (Anti-blood group A Fv) was selected, identity=59%. Amino acid sequence alignment between LYV5574 antibody and 1JV5 template is shown below, where | is the chain break and * indicates identical amino acid residues in both sequences.

```
LYV5574
DIQMTQAPSLLSASVGDRVTLNCKASQNVYKKLEWYQQKHGEAPKVVIH

HTNILQTGISS

1JV5
DIQMTQTTSSLSASLGDRVTISCRASQDINNYLNWYQQKPDGTVKLLIH

YTSRLHSGVPS

LYV5574
RFSGSGSGTDYTLTISSLQSEDVATYYCYQWNSGP-TFGAGTKLELKR|

QVKLLQSGAALV

1JV5
RFSGSGSGTDYSLTISNLEQEDIATYFCQQGNTLPWTFGGGTKLEIK-|

QVQLQQPGAELV

LYV5574
KPGASVKMSCKTSGYTFTDFWMSWVKQSHGKSLEWVGQIYPNTGTTHSN

EKFKGKATLTV

1JV5
KPGTSVKLSCKASGYNFTSYWINWVKLRPGQGLEWIGDIYPGSGITNYN

EKFKSKATLTV

LYV5574
                                       (SEQ ID NO: 102)
DKSTSTAYLELSRLTSEDSAIYYCSRSYHISTTPNWFAYWGQGTLVTV

SS

1JV5
                                       (SEQ ID NO: 104)
DTSSSTAYMQLSSLASEDSALYYCAGQYG----NLWFAYWGQGTLVTV

S-
```

Homology models were built using customized Build Homology Models protocol. Disulfide bridges were specified and linked. Loops were optimized using DOPE method. Based on the homology model of 1JV5, the sequences of LYV5574 antibody were analyzed. Framework region (FR) residues that are believed to be important for the binding activity, i.e. canonical FR residues and VH-VL interface residues of antibody were identified. We further analyzed the framework residues in inner core and identified four residues of LYV5574_VL-1 (grafted LYV5574_VL) for back mutation, which included L42 (buried residue with side chain size) and F71 (buried canonical residue). A humanized variant, LYV371_VL-2 (sequence shown below), was designed to have these residues changed back to LYV5574 antibody counterparts (L42V and F71Y; underlined and in boldface) to test if these were required to retain optimal activity.

```
>LYV5574_VL-2
                                       (SEQ ID NO: 32)
DIQMTQSPSSLSASVGDRVTITCKASQNVYKKLEWYQQKPGKVPKVLIY

HTNILQTGVPSRFSGSGSGTDYTLTISSLQPEDVATYYCYQWNSGPTFG

GGTKVEIKR
```

Recombinant full human IgG1/kappa of humanized LYV5574 antibodies were constructed using human IgG1 and human kappa light chain constant region. The humanized antibody Ly075 contains the CDR grafted VH-1 and VL-1 chains without back mutation, and antibody Ly076 comprises VH-1 and VL-2, which contains the two back mutations L42V and F71Y. Antibody Ly075 and Ly076, as well as the chimeric counterpart Ly074, were constructed as human IgG1/kappa (sequences shown below) molecules, expressed in and purified from HEK293 cells or CHO cells. The antibodies were purified by protein A affinity chromatography. The purified antibodies were checked for endotoxin (<5 EU/mg) and monomerization (>95%).

```
Ly074
Heavy chain (SEQ ID NO: 105):
QVKLLQSGAALVKPGASVKMSCKTSGYTFTDFWMSWVKQSHGKSLEWVG

QIYPNTGTTHSNEKFKGKATLTVDKSTSTAYLELSRLTSEDSAIYYCSR

SYHISTTPNWFAYWGQGTLVTVSSASTKGPSVFPLAPSSKSTSGGTAAL

GCLVKDYFPEPVTVSWNSGALTSGVHTFPAVLQSSGLYSLSSVVTVPSS

SLGTQTYICNVNHKPSNTKVDKKVEPKSCDKTHTCPPCPAPELLGGPSV

FLFPPKPKDTLMISRTPEVTCVVVDVSHEDPEVKFNWYVDGVEVHNAKT

KPREEQYNSTYRVVSVLTVLHQDWLNGKEYKCKVSNKALPAPIEKTISK

AKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHY

TQKSLSLSPGK

Light chain (SEQ ID NO: 106):
DIQMTQAPSLLSASVGDRVTLNCKASQNVYKKLEWYQQKHGEAPKVVIH

HTNILQTGISSRFSGSGSGTDYTLTISSLQSEDVATYYCYQWNSGPTFG

AGTKLELKRTVAAPSVFIFPPSDEQLKSGTASVVCLLNNFYPREAKVQW

KVDNALQSGNSQESVTEQDSKDSTYSLSSTLTLSKADYEKHKVYACEVT

HQGLSSPVTKSFNRGEC

Ly075 Light Chain (SEQ ID NO: 107):
DIQMTQSPSSLSASVGDRVTITCKASQNVYKKLEWYQQKPGKVPKLLIY

HTNILQTGVPSRFSGSGSGTDFTLTISSLQPEDVATYYCYQWNSGPTFG

GGTKVEIKRTVAAPSVFIFPPSDEQLKSGTASVVCLLNNFYPREAKVQW

KVDNALQSGNSQESVTEQDSKDSTYSLSSTLTLSKADYEKHKVYACEVT

HQGLSSPVTKSFNRGEC

Ly076 Light Chain (SEQ ID NO: 108):
DIQMTQSPSSLSASVGDRVTITCKASQNVYKKLEWYQQKPGKVPKVLIY

HTNILQTGVPSRFSGSGSGTDYTLTISSLQPEDVATYYCYQWNSGPTFG

GGTKVEIKRTVAAPSVFIFPPSDEQLKSGTASVVCLLNNFYPREAKVQW

KVDNALQSGNSQESVTEQDSKDSTYSLSSTLTLSKADYEKHKVYACEVT

HQGLSSPVTKSFNRGEC

Ly075 and Ly076 share the following common IgG1
heavy chain constant region (SEQ ID NO: 109):
QVQLVQSGAEVKKPGASVKVSCKASGYTFTDFWMSWVRQAPGQGLEWMG

QIYPNTGTTHSNEKFKGRVTMTRDTSTSTVYMELSSLRSEDTAVYYCAR

SYHISTTPNWFAYWGQGTLVTVSSASTKGPSVFPLAPSSKSTSGGTAAL

GCLVKDYFPEPVTVSWNSGALTSGVHTFPAVLQSSGLYSLSSVVTVPSS

SLGTQTYICNVNHKPSNTKVDKKVEPKSCDKTHTCPPCPAPELLGGPSV

FLFPPKPKDTLMISRTPEVTCVVVDVSHEDPEVKFNWYVDGVEVHNAKT

KPREEQYNSTYRVVSVLTVLHQDWLNGKEYKCKVSNKALPAPIEKTISK
```

-continued

```
AKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHY

TQKSLSLSPGK
```

Characterization of Anti-PD-L1 Antibodies (i) Binding Activity to Cell Surface PD-L1

The anti-PD-L1 antibodies disclosed herein were analyzed by FACS for their binding properties to human PD-L1 expressed on CHO cells. Briefly, cultured cells were harvested, counted and cell viability was evaluated using the Trypan Blue exclusion method. Viable cells were then adjusted to $2 \times 10^6$ cells per mL in PBS containing 2% BSA. 100 μL of this cell suspension were further aliquoted per well into a V-bottom 96-well plate. 50 μL of the antibodies or IgG control were added to the cell-containing wells to obtain final concentrations of 0.1 μg/mL to 10 μg/mL. After incubation for 2 hours at 4° C., cells were centrifuged (3 min, 1000×g), washed with 250 μL/well BSA-containing FACS Stain Buffer, resuspended and incubated for an additional 1 hour at 4° C. with 100 μL/well fluorochrome-conjugated anti-IgG antibody for detection of the antibody. Cells were then washed with 250 μL/well BSA-containing FACS Stain Buffer, resuspended in 100 μL/well FACS Stain Buffer, acquired and analyzed using a FACS machine.

Figure 5:
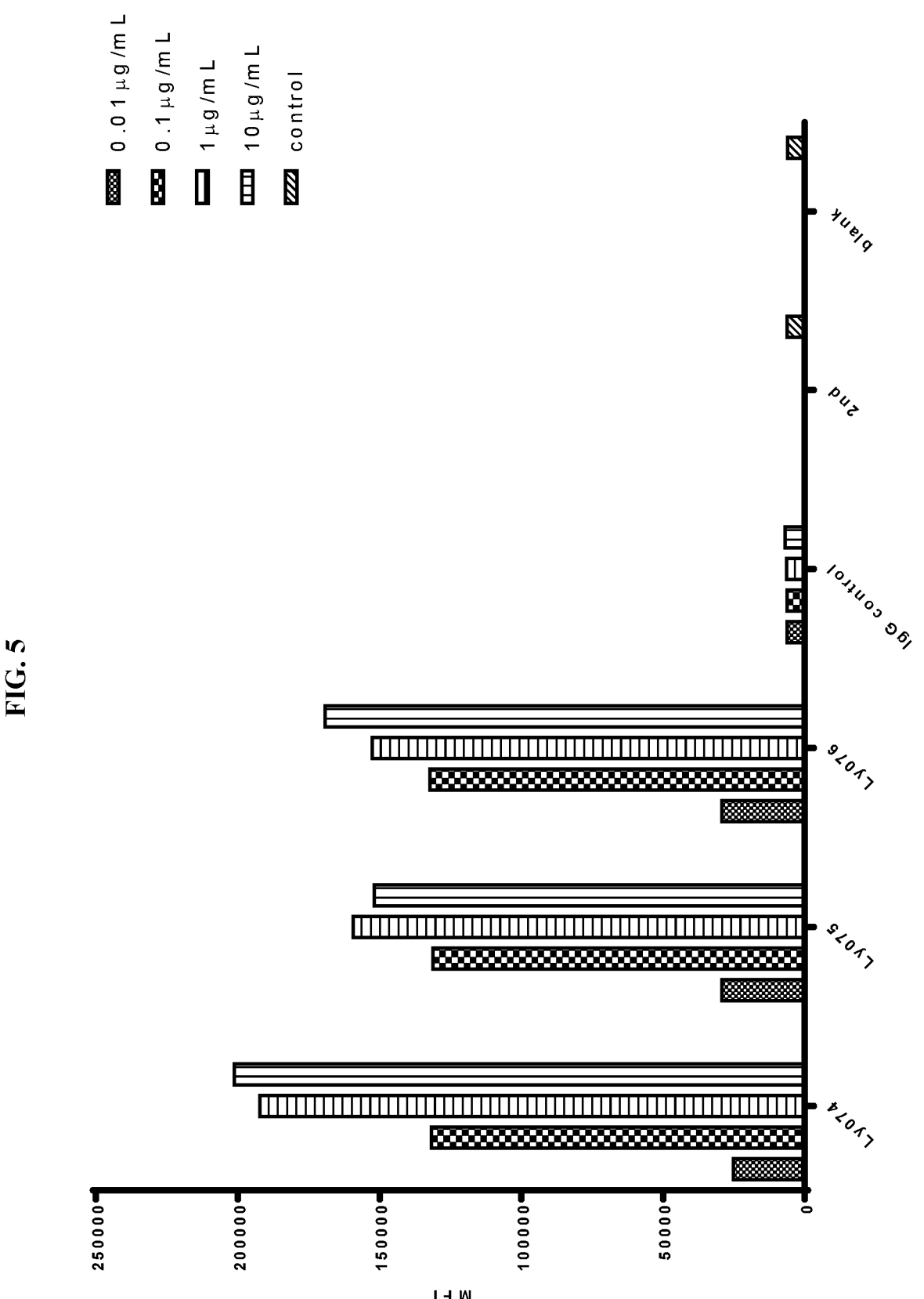
FIG. 5 is a chart showing binding activity of anti-PD-L1 antibodies as indicated on the x-axis to human PD-L1 expressed on CHO cells. The bars labeled as "IgG control", "2nd" and "blank" served as controls. Binding of these anti-PD-L1 antibodies are indicated by the mean fluorescence intensity (MFI) on the y-axis.

Binding of the antibodies to human PD-L1 expressing CHO cells were evaluated and the mean fluorescence intensity is plotted in histograms or dot plots as shown in FIG. 5. Both humanized versions of the anti-PD-L1 antibodies showed similar binding activity to the cell surface PD-L1.

(ii) Blockage of PD-1/PD-L1 Interaction

To determine the ability of the antibodies in blocking PD-L1/PD-1 cellular function, a reporter assay system was used. The assay consisted of two genetically engineered cell lines: Raji-PD-L1 cells were Raji cells expressing human PD-L1. Jurkat/NFκB-Luci/PD-1 cells are Jurkat cells expressing human PD-1 and a luciferase reporter driven by an NFκB response element. Briefly, Raji-PD-L1 cells were harvested and adjusted to $2 \times 10^6$ cells/mL, further aliquoted at 25 μL/well into a 96-well plate. Then 25 μL/well anti-CD3 antibody at 4 μg/mL was added into a 96-well plate, tested antibodies at 4× final concentrations were added at 25 μL/well. The plate was incubated at 37° C. for 20 mins. Human PD-1 over-expressing Jurkat/NFκB-Luci were harvested and adjusted to $1.5 \times 10^6$ cells/mL, 25 μL of Jurkat cell suspension was dispensed to the wells containing Raji cells, anti-CD3 antibody and tested antibodies. The plate was incubated for additional 6 hours at 37° C. then subjected for Bright-Glo™ Luciferase Assay using Kit from Promega #E2620. Addition of either an anti-PD-1 or anti-PD-L1 antibody that blocks the PD-1/PD-L1 interaction releases the inhibitory signal and results in NFκB-mediated luminescence.

Figure 6:
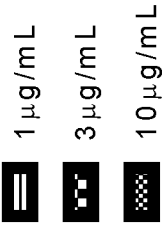
FIG. 6 is a chart showing the blocking effect of anti-PD-L1 antibodies. The antibodies are indicated on the x-axis, and the RLU signal on the y-axis reflects the blockade of PD-1/PD-L1 interaction leading to increased signal.

As shown in FIG. 6, the two humanized versions of the anti-PD-L1 antibodies showed potent and similar blocking activity.

(iii) Anti-Tumor Activity

The two humanized anti-PD-L1 antibodies were further examined in mouse syngeneic tumor models in vivo to determine their anti-tumor efficacy. Human PD-L1 overexpressing murine colon cancer MC38 cells were subcutaneously implanted into homozygous human PD-L1 knock-in C57BL/6 mice on day 0. Mice were grouped when the tumor size was approximately 150±50 mm³ (n=6). Anti-PD-L1 antibodies were administered by intraperitoneal injections and tumor sizes were measure during 4-6 weeks of antibody treatment. Tumor sizes were calculated as tumor volume using formula of 0.5×length×width$^2$. Anti-tumor efficacy was evaluated between tumor sizes of the control group and antibody treatment group.

Figure 7:
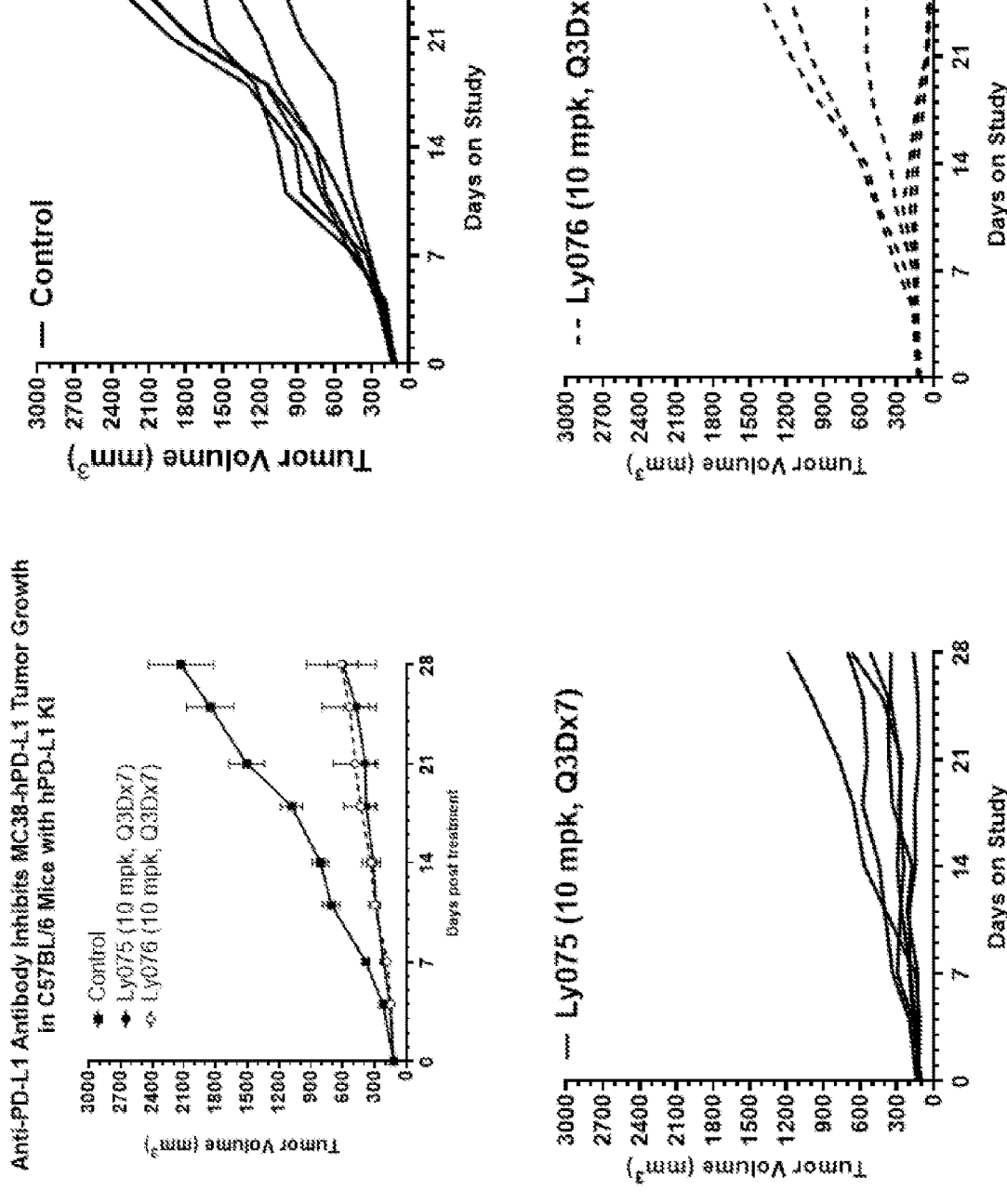
FIG. 7 is a set of graphs showing the anti-tumor activity of anti-PD-L1 antibodies in a human PD-L1 knock-in mouse syngeneic model with human PD-L1 overexpressing MC38 tumor cells. The mean and individual tumor volumes were shown. Top left panel: anti-tumor effects of Clones Ly075 and Ly076. Top right panel: control. Bottom left panel: anti-tumor effect of Clone Ly075. Bottom right panel: anti-tumor effect of Clone Ly076.

As shown in FIG. 7, both two anti-PD-L1 antibodies, Ly075 and Ly076, showed strong anti-tumor activity compared to vehicle control, however, Ly076 induced complete tumor regression in 3 of 6 mice.

Preparation of Anti-PD-L1/CD40 Bi-Specific Antibodies

Anti-PD-L1/CD40 bi-specific antibodies were designed using the exemplary human or humanized anti-CD40 and anti-PD-L1 antibodies disclosed herein. cDNAs encoding the VH and VL chains of anti-PD-L1 antibody Ly076 and the VH and VL chains of the anti-CD40 antibodies TM740, TM559 and Ly253 are used as the starting materials. CHO transient expression was carried out with plasmids coding for the corresponding heavy and light chain sequences. These antibodies were purified by protein A affinity chromatography. The amino acid sequences of the heavy chain (HC) and the light chain (LC) of the bi-specific antibodies are provided below:

```
Ly301:
First Polypeptide (from N→C terminus, heavy chain of Ly076 with IgG1 mutated Fc
region and scFv of TM740 in VL→VH orientation; SEQ ID NO: 110):
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGGGGSGGGGSGGGGSGGGGSDIQMTQSPSSLSA

SVGDRVTITCKASQNIYIYLNWYQQKPGKAPKLLIYNTNNLQTGVPSRFSGSGSGTDFTLTISSLQPED

FATYYCLQHSSRRTFGGGTKVEIKGGGGSGGGGSGGGGSGGGGSQVQLVESGGGLVQPGGSLKLSCATS

GFNFNDYFMNWVRQASGKGLEWVGQIRNKNYNYATYYTESLEGRVTISRDDSKNTAYLQMNSLKTEDTA

VYYCTSYYYDGFADYFDYWGQGTTVTVSS

Second Polypeptide: light chain of Ly076 (SEQ ID NO: 108).

Ly338
First Polypeptide (from N→C terminus, heavy chain of Ly076 with IgG1 mutated Fc
region Fc domain and scFv of TM740 in VH→VL orientation; SEQ ID NO: 111):
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGGGGSGGGGSGGGGSGGGGSQVQLVESGGGLVQ

PGGSLKLSCATSGFNFNDYFMNWVRQASGKGLEWVGQIRNKNYNYATYYTESLEGRVTISRDDSKNTAY

LQMNSLKTEDTAVYYCTSYYYDGFADYFDYWGQGTTVTVSSGGGGSGGGGSGGGGSGGGGSDIQMTQSP

SSLSASVGDRVTITCKASQNIYIYLNWYQQKPGKAPKLLIYNTNNLQTGVPSRFSGSGSGTDFTLTISS

LQPEDFATYYCLQHSSRRTFGGGTKVEIK

Second Polypeptide: Ly076 light chain (SEQ ID NO: 108)

Ly349
First polypeptide: heavy chain of Ly076 with IgG1 mutated Fc (SEQ ID NO: 112):
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE
```

-continued

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPG

Second polypeptide (from N→C terminus, light chain of Ly076 and scFv of TM740 in
VL→VH orientation, SEQ ID NO: 113):
DIQMTQSPSSLSASVGDRVTITCKASQNVYKKLEWYQQKPGKVPKVLIYHTNILQTGVPSRFSGSGSGT

DYTLTISSLQPEDVATYYCYQWNSGPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCKASQNIYIYLNWYQQKPGKA

PKLLIYNTNNLQTGVPSRFSGSGSGTDFTLTISSLQPEDFATYYCLQHSSRRTFGGGTKVEIKGGGGSG

GGGSGGGGSGGGGSQVQLVESGGGLVQPGGSLKLSCATSGFNFNDYFMNWVRQASGKGLEWVGQIRNKN

YNYATYYTESLEGRVTISRDDSKNTAYLQMNSLKTEDTAVYYCTSYYYDGFADYFDYWGQGTTVTVSS

Ly339
First polypeptide: heavy chain of Ly349 (SEQ ID NO: 112)

Second polypeptide (from N→C terminus, light chain of Ly076 and scFv of TM740 in
VH→VL orientation, SEQ ID NO: 114):
DIQMTQSPSSLSASVGDRVTITCKASQNVYKKLEWYQQKPGKVPKVLIYHTNILQTGVPSRFSGSGSGT

DYTLTISSLQPEDVATYYCYQWNSGPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVESGGGLVQPGGSLKLSCATSGFNFNDYFMNWVRQASGK

GLEWVGQIRNKNYNYATYYTESLEGRVTISRDDSKNTAYLQMNSLKTEDTAVYYCTSYYYDGFADYFDY

WGQGTTVTVSSGGGGSGGGGSGGGGSGGGGSDIQMTQSPSSLSASVGDRVTITCKASQNIYIYLNWYQQ

KPGKAPKLLIYNTNNLQTGVPSRFSGSGSGTDFTLTISSLQPEDFATYYCLQHSSRRTFGGGTKVEIK

Ly303
First polypeptide (from N→C terminus, heavy chain of Ly076 with IgG1 mutated Fc
domain and scFv of TM559 in VL→VH orientation, SEQ ID NO: 115):
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGGGGGSGGGGSGGGGSGGGGSDIQMTQSPSSLSA

SVGDRVTITCLASEDISNDLAWYQQKPGKAPKLLIYFVDRLLDGVPSRFSGSGSGTDFTLTISSLQPED

FATYYCQQSYKYPPTFGQGTKLEIKGGGGSGGGGSGGGGSGGGGSEVQLVESGGGLVQPGGSLRLSCAA

SGFTFTNYGLHWVRQAPGKGLEWVSSISPSGGVTYYRDSVKGRFTISRDNSKNTLYLQMNSLRAEDTAV

YYCAKPFLGWGGANWIAHWGQGTLVTVSS

Second polypeptide: light chain of Ly076 (SEQ ID NO: 108)

Ly340
First polypeptide (from N→C terminus, heavy chain of Ly076 with IgG1 mutated Fc
region and scFv of TM559 in VH→VL orientation, SEQ ID NO: 116):
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGGGGSGGGGSGGGGSGGGGSEVQLVESGGGLVQ

PGGSLRLSCAASGFTFTNYGLHWVRQAPGKGLEWVSSISPSGGVTYYRDSVKGRFTISRDNSKNTLYLQ

MNSLRAEDTAVYYCAKPFLGWGGANWIAHWGQGTLVTVSSGGGGSGGGGSGGGGSGGGGSDIQMTQSPS

SLSASVGDRVTITCLASEDISNDLAWYQQKPGKAPKLLIYFVDRLLDGVPSRFSGSGSGTDFTLTISSL

QPEDFATYYCQQSYKYPPTFGQGTKLEIK

Second polypeptide: Ly076 light chain (SEQ ID NO: 108)

Ly341
First polypeptide: heavy chain of Ly349 (SEQ ID NO: 112)

Second polypeptide (from N→C terminus, light chain of Ly075 and scFv of TM559 in
VH→VL orientation, SEQ ID NO: 118):
DIQMTQSPSSLSASVGDRVTITCKASQNVYKKLEWYQQKPGKVPKVLIYHTNILQTGVPSRFSGSGSGT

DYTLTISSLQPEDVATYYCYQWNSGPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSEVQLVESGGGLVQPGGSLRLSCAASGFTFTNYGLHWVRQAPGK

GLEWVSSISPSGGVTYYRDSVKGRFTISRDNSKNTLYLQMNSLRAEDTAVYYCAKPFLGWGGANWIAHW

GQGTLVTVSSGGGGSGGGGSGGGGSGGGGSDIQMTQSPSSLSASVGDRVTITCLASEDISNDLAWYQQK

PGKAPKLLIYFVDRLLDGVPSRFSGSGSGTDFTLTISSLQPEDFATYYCQQSYKYPPTFGQGTKLEIK

Ly350
First polypeptide: heavy chain of Ly349 (SEQ ID NO: 112)

Second polypeptide (from N→C terminus, light chain of Ly076 and scFv of TM559 in
VL→VH orientation, SEQ ID NO: 117):
DIQMTQSPSSLSASVGDRVTITCKASQNVYKKLEWYQQKPGKVPKVLIYHTNILQTGVPSRFSGSGSGT

DYTLTISSLQPEDVATYYCYQWNSGPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCLASEDISNDLAWYQQKPGKA

PKLLIYFVDRLLDGVPSRFSGSGSGTDFTLTISSLQPEDFATYYCQQSYKYPPTFGQGTKLEIKGGGGS

GGGGSGGGGSGGGGSEVQLVESGGGLVQPGGSLRLSCAASGFTFTNYGLHWVRQAPGKGLEWVSSISPS

GGVTYYRDSVKGRFTISRDNSKNTLYLQMNSLRAEDTAVYYCAKPFLGWGGANWIAHWGQGTLVTVSS

Ly342
First polypeptide (from N→C terminus, heavy chain of Ly076 with IgG1 mutated Fc
region and scFv of Ly253 in VL→VH orientation, SEQ ID NO: 119):
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGGGGSGGGGSGGGGSGGGGSDIQMTQSPSSVSA

SVGDRVTITCRASQGIYSWLAWYQQKPGKAPNLLIYTASTLQSGVPSRFSGSGSGTDFTLTISSLQPED

FATYYCQQANIFPLTFGGGTKVEIKGGGGSGGGGSGGGGSGGGGSQVQLVQSGAEVKKPGASVKVSCKA

SGYTFTGYYMHWVRQAPGQGLEWMGWINPDSGGTNYAQKFQGRVTMTRDTSISTAYMELNRLRSDDTAV

YYCARDQPLGYCTNGVCSYFDYWGQGTLVTVSS

-continued

Second polypeptide: light chain of Ly076 (SEQ ID NO: 108)

Ly343
First polypeptide: heavy chain of Ly349 (SEQ ID NO: 112)

Second polypeptide (from N→C terminus, light chain of Ly076 and scFv of Ly253 in
VL→VH orientation, (SEQ ID NO: 121)
DIQMTQSPSSLSASVGDRVTITCKASQNVYKKLEWYQQKPGKVPKVLIYHTNILQTGVPSRFSGSGSGT

DYTLTISSLQPEDVATYYCYQWNSGPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSVSASVGDRVTITCRASQGIYSWLAWYQQKPGKA

PNLLIYTASTLQSGVPSRFSGSGSGTDFTLTISSLQPEDFATYYCQQANIFPLTFGGGTKVEIKGGGGS

GGGGSGGGGSGGGGSQVQLVQSGAEVKKPGASVKVSCKASGYTFTGYYMHWVRQAPGQGLEWMGWINPD

SGGTNYAQKFQGRVTMTRDTSISTAYMELNRLRSDDTAVYYCARDQPLGYCTNGVCSYFDYWGQGTLVT

VSS

Ly344
First polypeptide (from N→C terminus, heavy chain of Ly076 with IgG1 mutated Fc
region and scFv of Ly253 in VH→VL orientation, SEQ ID NO: 120)
QVQLVQSGAEVKKPGASVKVSCKASGYTFTDFWMSWVRQAPGQGLEWMGQIYPNTGTTHSNEKFKGRVT

MTRDTSTSTVYMELSSLRSEDTAVYYCARSYHISTTPNWFAYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGGGGSGGGGSGGGGSGGGGSQVQLVQSGAEVKK

PGASVKVSCKASGYTFTGYYMHWVRQAPGQGLEWMGWINPDSGGTNYAQKFQGRVTMTRDTSISTAYME

LNRLRSDDTAVYYCARDQPLGYCTNGVCSYFDYWGQGTLVTVSSGGGGSGGGGSGGGGSGGGGSDIQMT

QSPSSVSASVGDRVTITCRASQGIYSWLAWYQQKPGKAPNLLIYTASTLQSGVPSRFSGSGSGTDFTLT

ISSLQPEDFATYYCQQANIFPLTFGGGTKVEIK

Second polypeptide: light chain of Ly076 (SEQ ID NO: 108)

Ly345
First polypeptide: heavy chain of Ly349 (SEQ ID NO: 112)

Second polypeptide (from N→C terminus, light chain of Ly076 and scFv of Ly253 in
VH→VL orientation; SEQ ID NO: 122)
DIQMTQSPSSLSASVGDRVTITCKASQNVYKKLEWYQQKPGKVPKVLIYHTNILQTGVPSRFSGSGSGT

DYTLTISSLQPEDVATYYCYQWNSGPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVQSGAEVKKPGASVKVSCKASGYTFTGYYMHWVRQAPGQ

GLEWMGWINPDSGGTNYAQKFQGRVTMTRDTSISTAYMELNRLRSDDTAVYYCARDQPLGYCTNGVCSY

FDYWGQGTLVTVSSGGGGSGGGGSGGGGSGGGGSDIQMTQSPSSVSASVGDRVTITCRASQGIYSWLAW

YQQKPGKAPNLLIYTASTLQSGVPSRFSGSGSGTDFTLTISSLQPEDFATYYCQQANIFPLTFGGGTKV

EIK

In some embodiments, the anti-PD-L1/anti-CD40 bispecific antibodies disclosed herein comprise a first polypeptide, which is a fusion polypeptide comprising the anti-CD40 portion in scFv format and the heavy chain of the anti-PD-L1 portion. In some examples, the anti-CD40 scFv may be in VH→VL orientation. Alternatively, the anti-CD40 scFv may be in VL→VH orientation. In some examples, the heavy chain of the anti-PD-L1 portion may be located at the N-terminal of the first polypeptide. In other instances, the anti-CD40 scFv portion may be located at the N-terminal of the first polypeptide. The anti-PD-L1/anti-CD40 bispecific antibodies in this format (e.g., Ly338, Ly303, Ly340, and Ly342) were found to exhibit unexpected superior features, for example, superior anti-tumor activities with no apparent liver toxicity as shown herein, for example, the data provided below.

Characterization of Anti-PD-L1/CD40 Bi-Specific Antibodies (i) Binding Activity

Anti-PD-L1/CD40 bi-specific antibodies were analyzed by FACS for their binding properties to human PD-L1 and/or human CD40 expressed on CHO cells. Briefly, cultured cells were harvested, counted and cell viability was evaluated using the Trypan Blue exclusion method. Viable cells were then adjusted to $2 \times 10^6$ cells per mL in PBS containing 2% BSA. 100 µL of this cell suspension were further aliquoted per well into a V-bottom 96-well plate. 50 µL of the bi-specific antibodies or corresponding IgG control were added to the cell-containing wells to obtain final concentrations of 0.1 µg/mL to 10 µg/mL. After incubation for 2 hours at 4° C., cells were centrifuged (3 min, 1000×g), washed with 250 µL/well BSA-containing FACS Stain Buffer, resuspended and incubated for an additional 1 hour at 4° C. with 100 µL/well fluorochrome-conjugated anti-IgG antibody for detection of the bispecific antibody. Cells were then washed with 250 µL/well BSA-containing FACS Stain Buffer, resuspended in 100 µL/well FACS Stain Buffer, acquired and analyzed using a FACS machine. Binding of the bispecific antibodies to human PD-L1 or human CD40 expressing CHO cells were evaluated and the mean fluorescence intensity is plotted in histograms or dot plots.

Figure 8A:
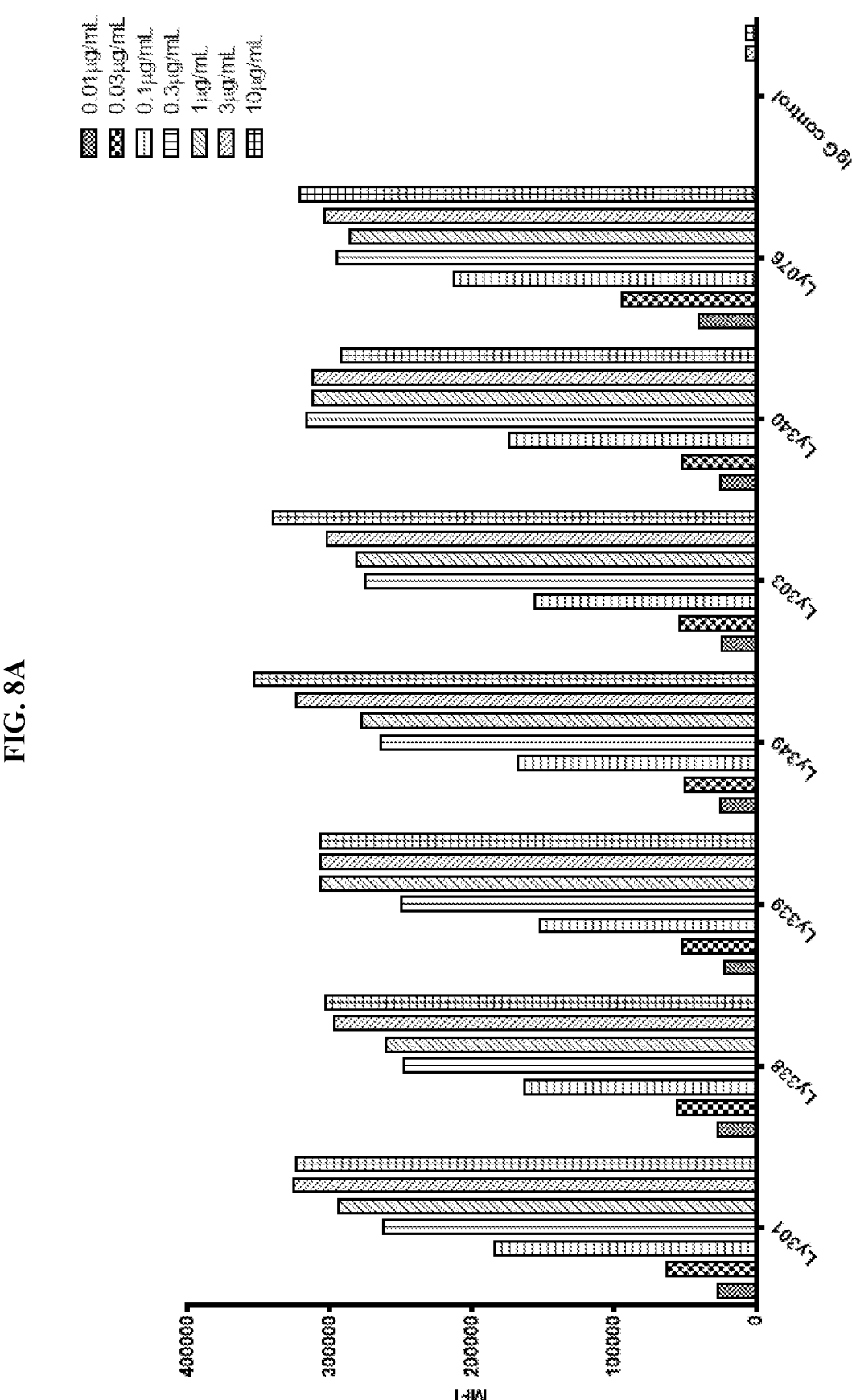
FIGS. 8A-8B are charts showing PD-L1 binding activity of anti-PD-L1/CD40 bispecific antibodies as indicated on the x-axis to human PD-L1 expressed on CHO cells. The bars labeled "IgG control" served as controls. Binding of these anti-PD-L1/CD40 bispecific antibodies are indicated by the mean fluorescence intensity (MFI) on the y-axis. 8A: Clones Ly301, Ly338, Ly339, Ly349, Ly303, Ly340 and Ly076 at various concentrations as indicated. 8B: Clones Ly341, Ly350, Ly342, Ly343, Ly344, Ly345 and Ly076 at various concentrations as indicated.
Figure 8B:
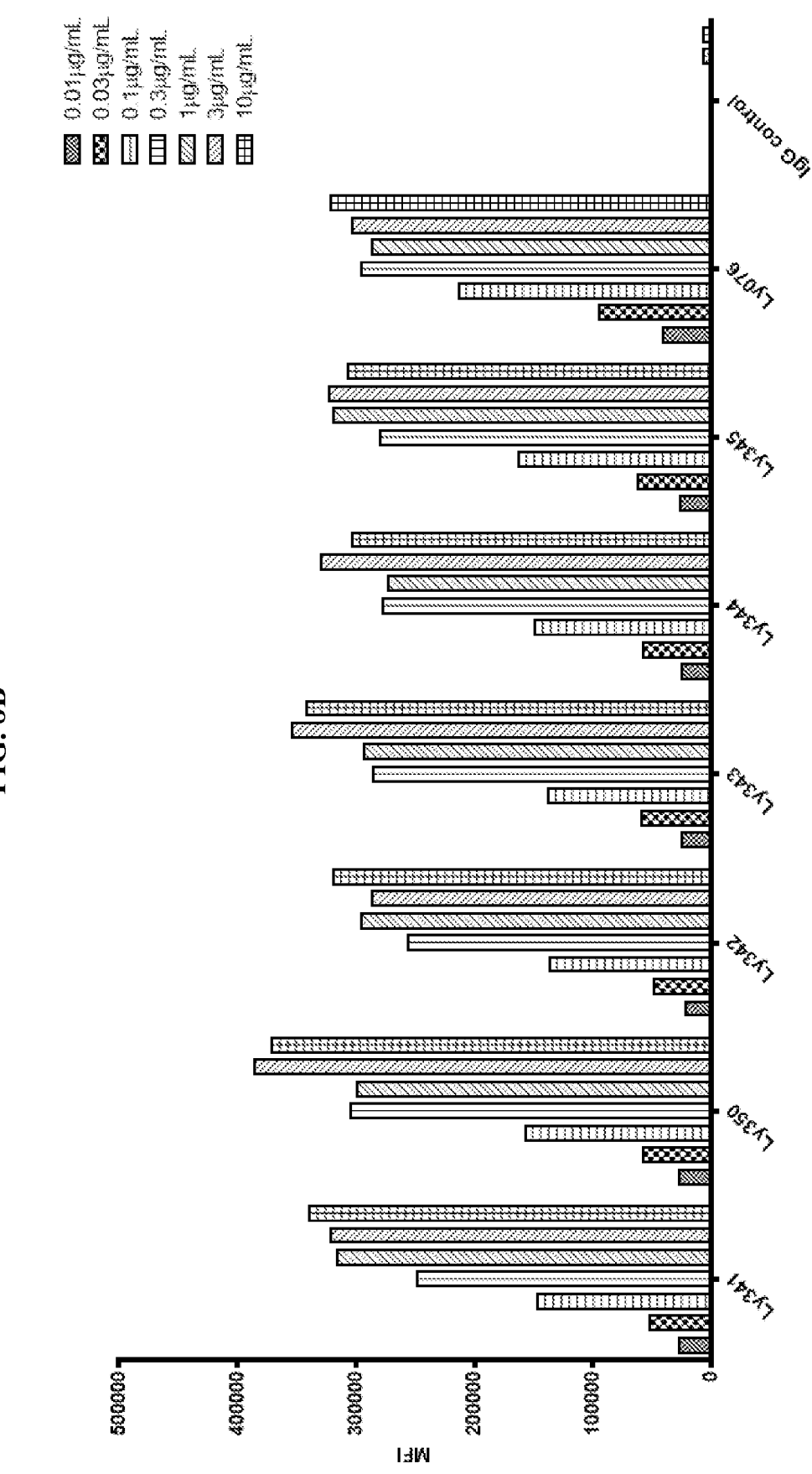
Figure 9A:
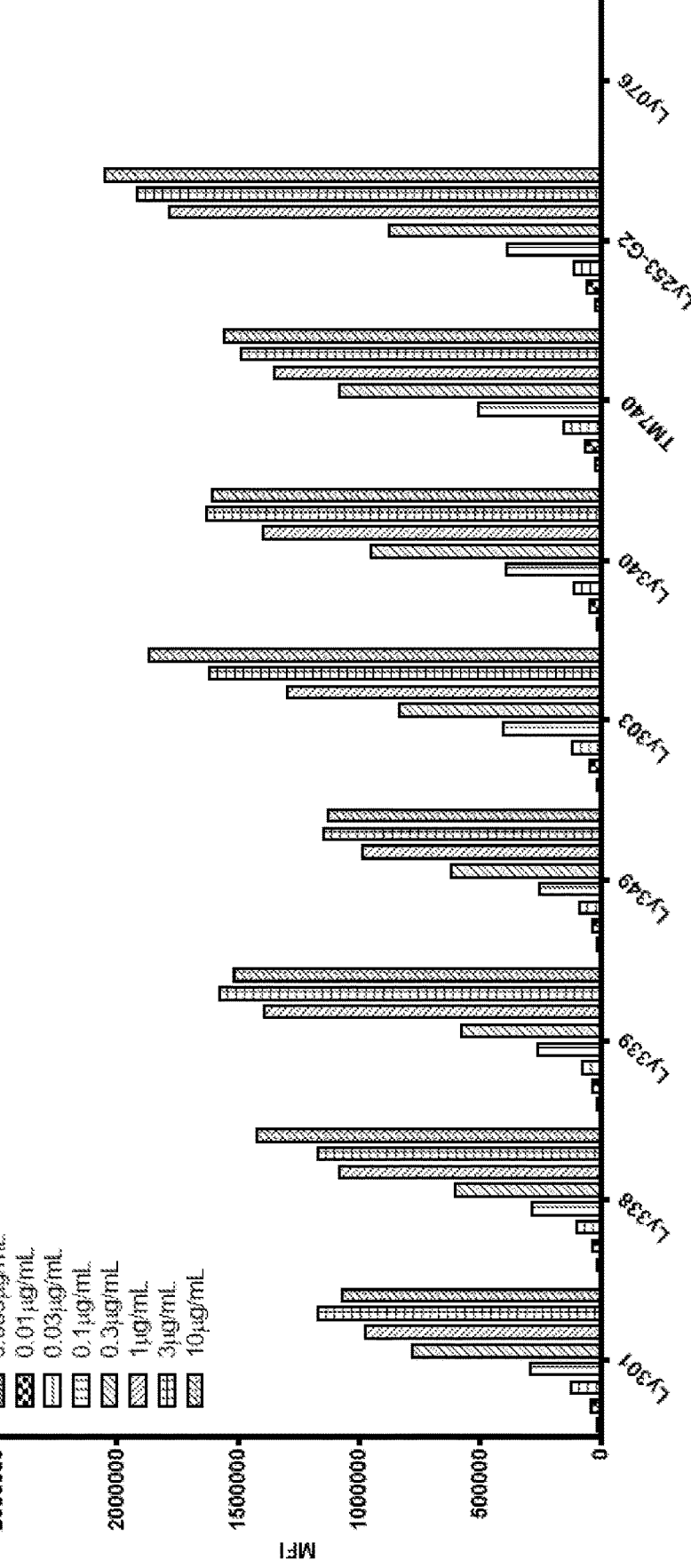
FIGS. 9A-9B are charts showing CD40 binding activity of anti-PD-L1/CD40 bispecific antibodies as indicated on the x-axis to human CD40 expressed on CHO cells. Ly076 was used as controls. Binding of these anti-PD-L1/CD40 bispecific antibodies are indicated by the mean fluorescence intensity (MFI) on the y-axis. 9A: Clones Ly301, Ly338, Ly339, Ly349, Ly303, Ly340, TM740, Ly253-G2 and Ly076 at various concentrations as indicated. 9B: Clones Ly341, Ly350, Ly342, Ly343, Ly344, Ly345, TM740, Ly253-G2 and Ly076 at various concentrations as indicated.
Figure 9B:
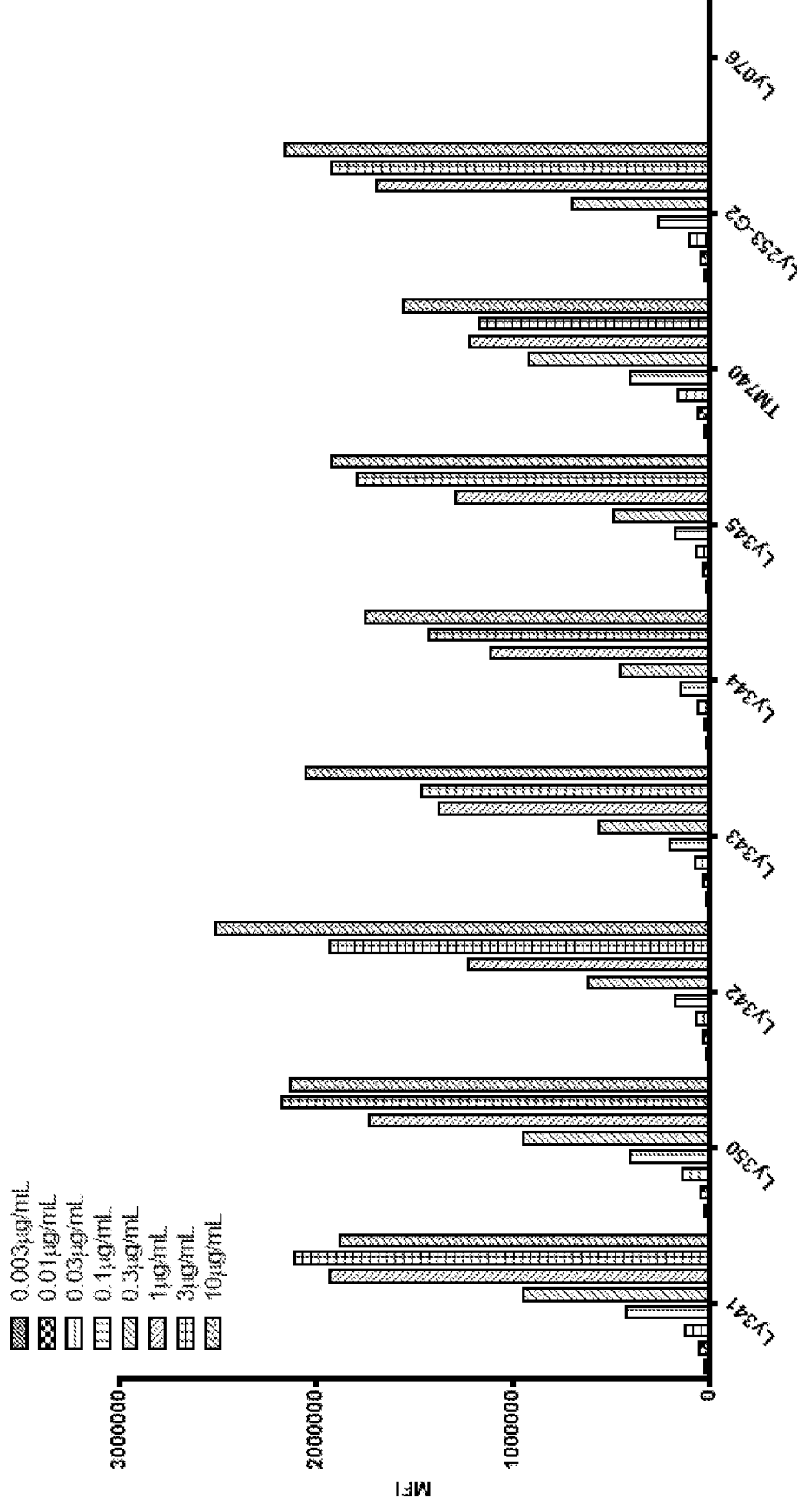
Figure 10A:
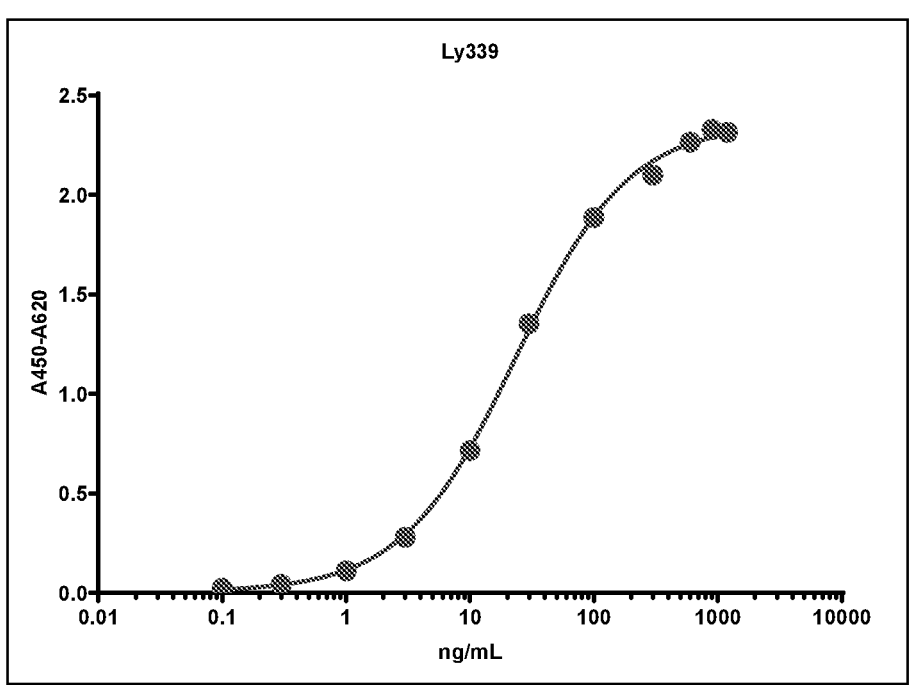
FIGS. 10A-10L are charts showing simultaneously binding of exemplary anti-PD-L1/CD40 antibodies to recombinant human PD-L1 and CD40 proteins. Clones Ly339 (10A), Ly303 (10B), Ly349 (10C), Ly338 (10D), Ly342 (10E), Ly301 (10F), Ly343 (10G), Ly341 (10H), Ly340 (10I), Ly345 (10J), Ly350 (10K), and Ly344 (10L) at various concentrations as indicated.
Figure 10B:
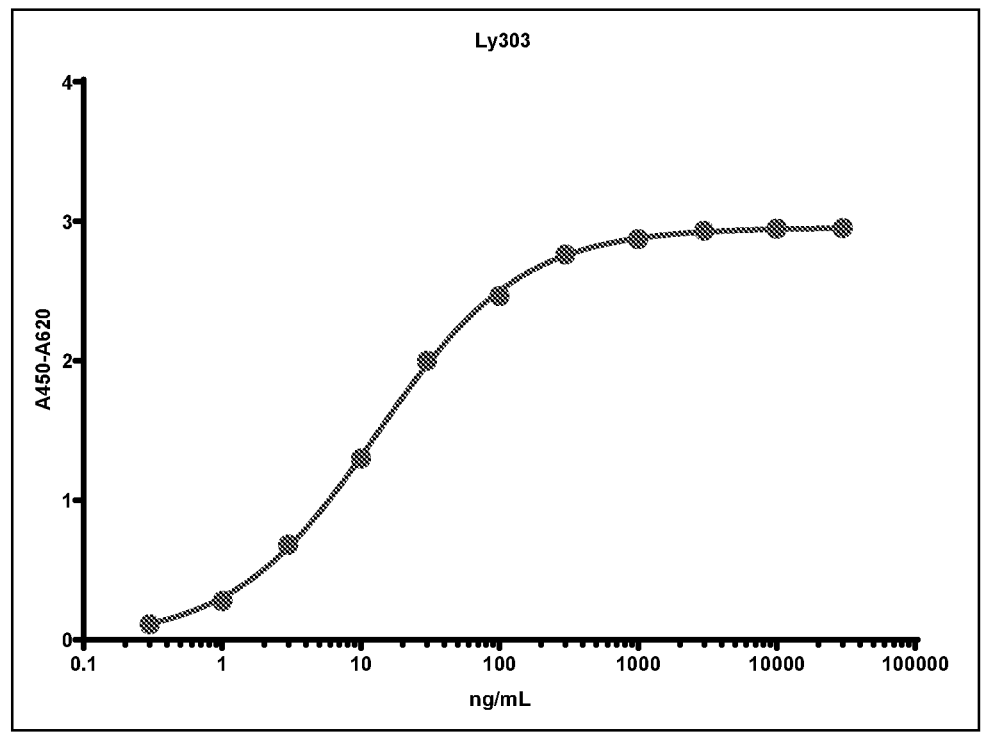
Figure 10C:
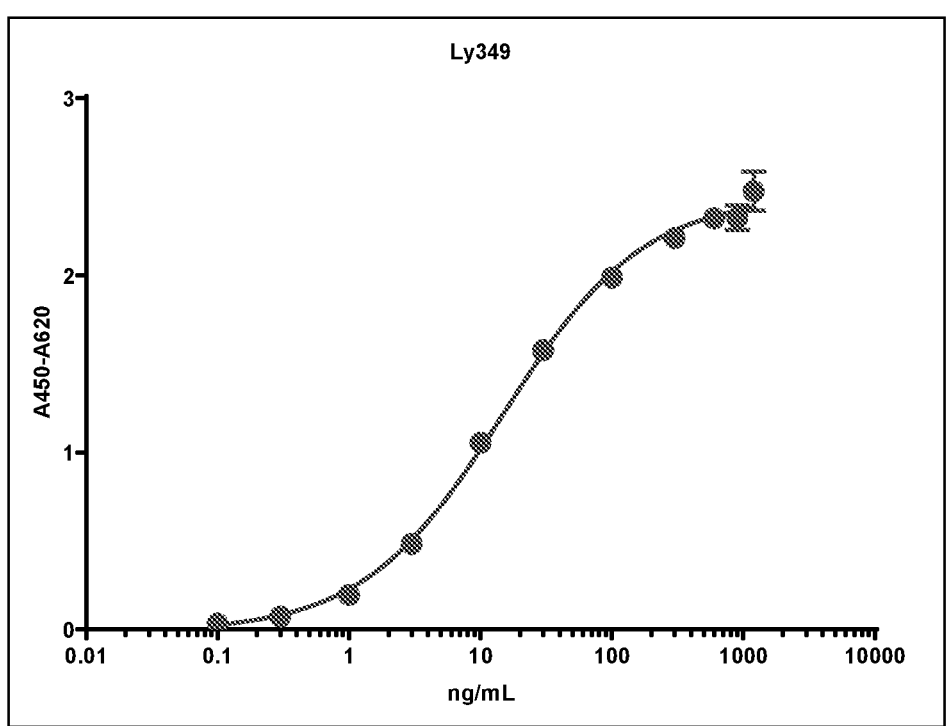
Figure 10D:
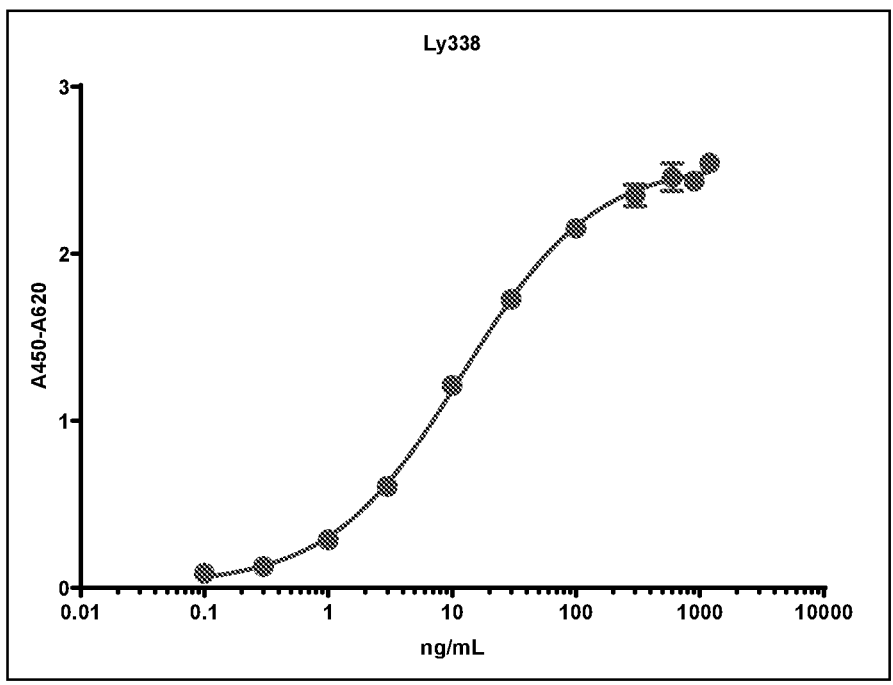
Figure 10E:
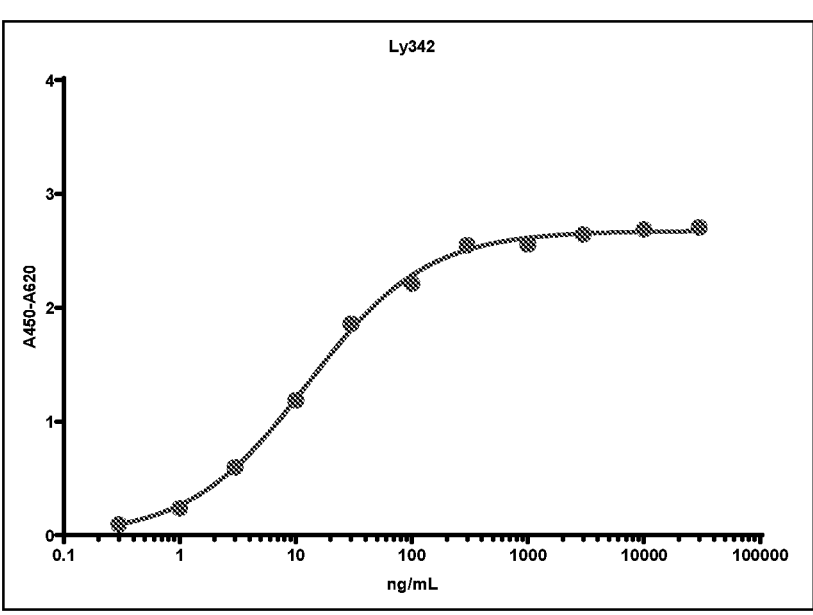
Figure 10F:
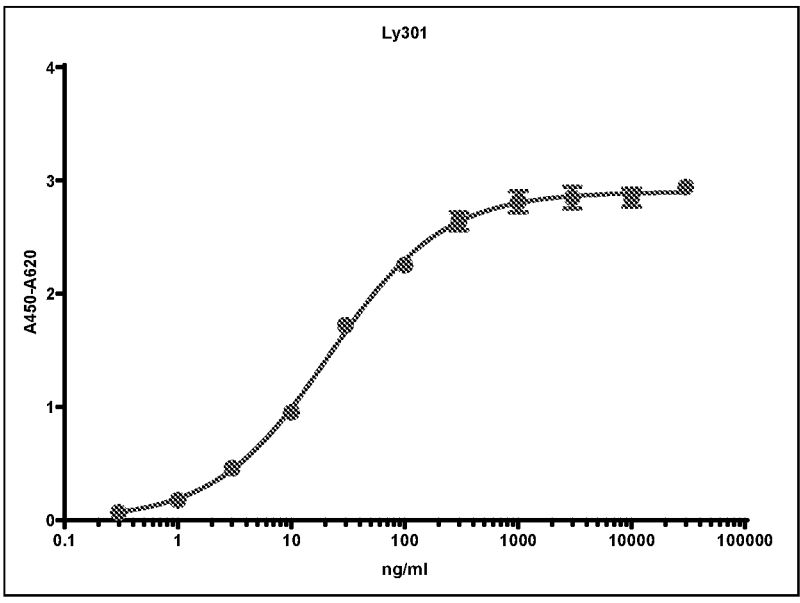
Figure 10G:
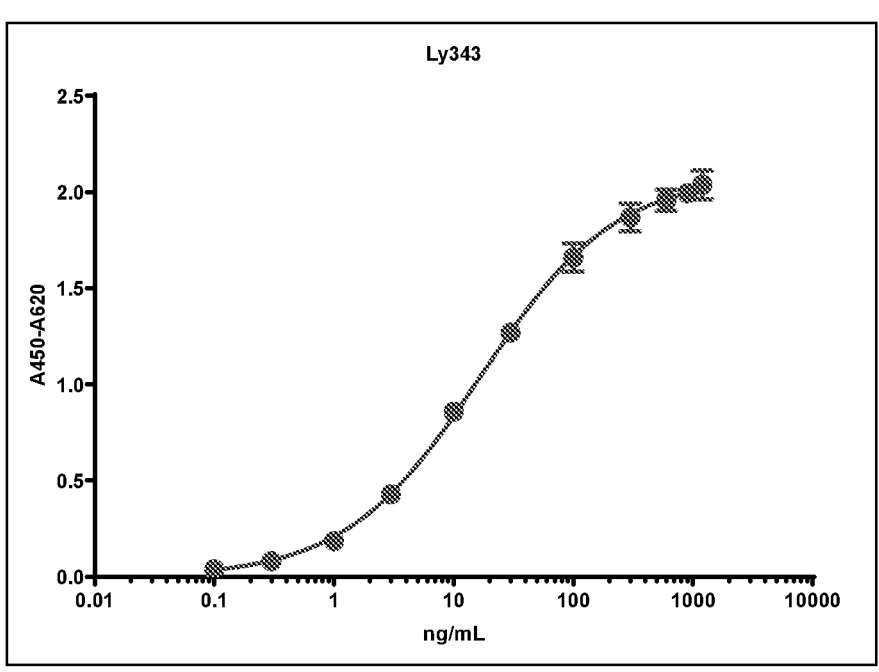
Figure 10H:
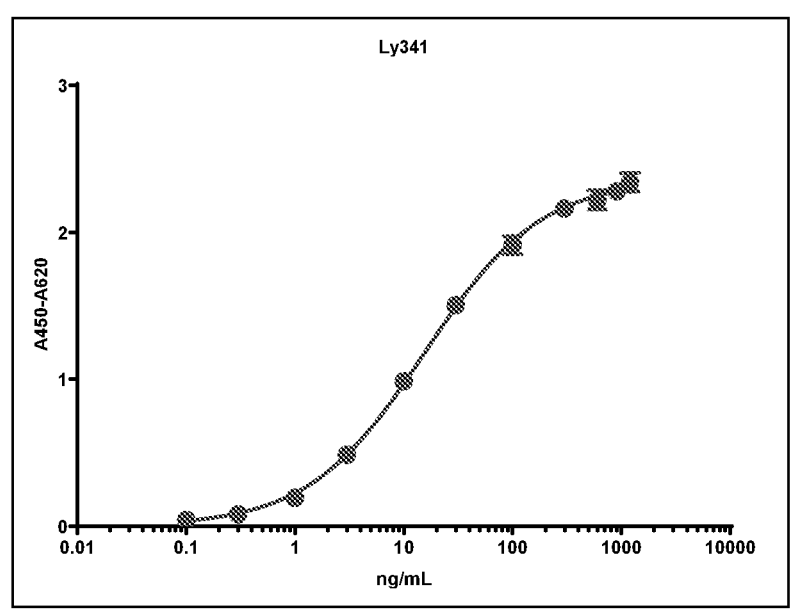
Figure 10I:
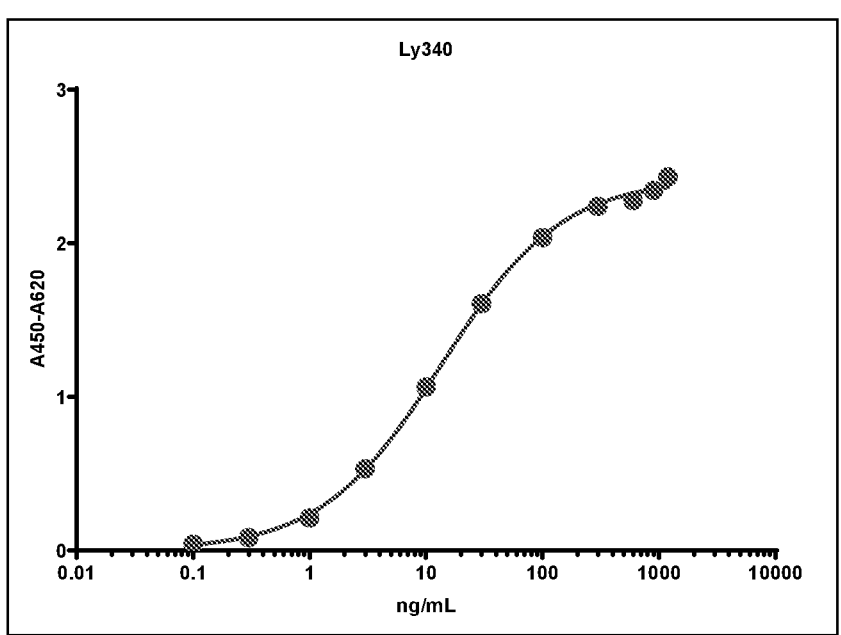
Figure 10J:
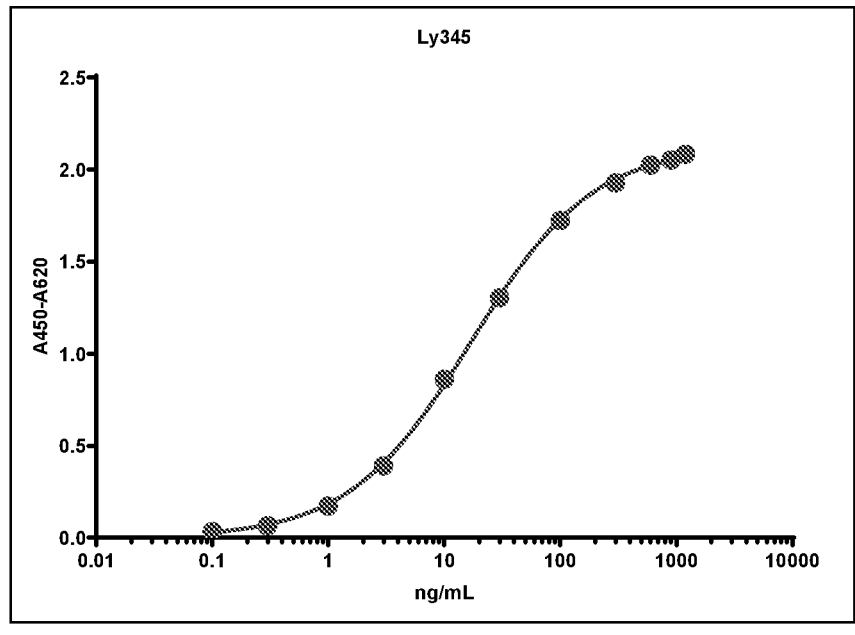
Figure 10K:
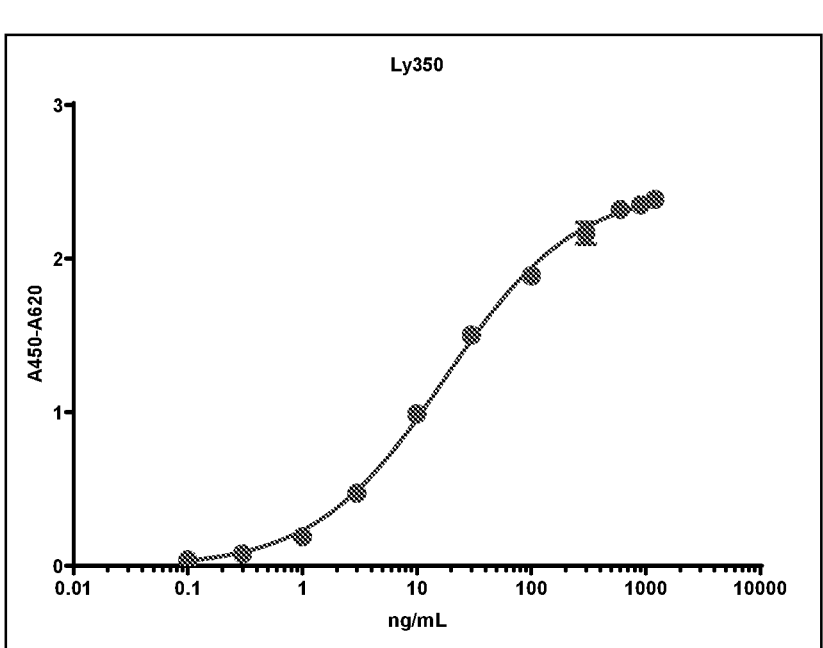
Figure 10L:
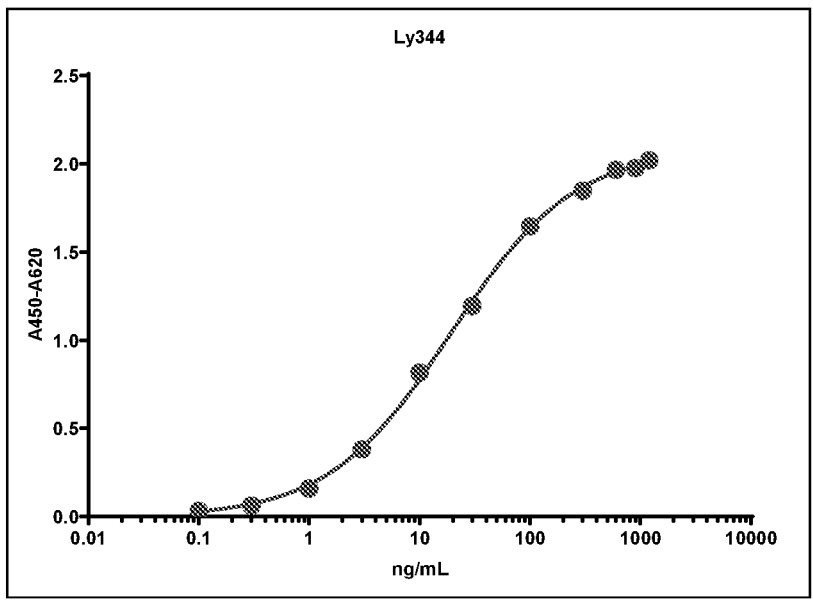
Figure 11A:
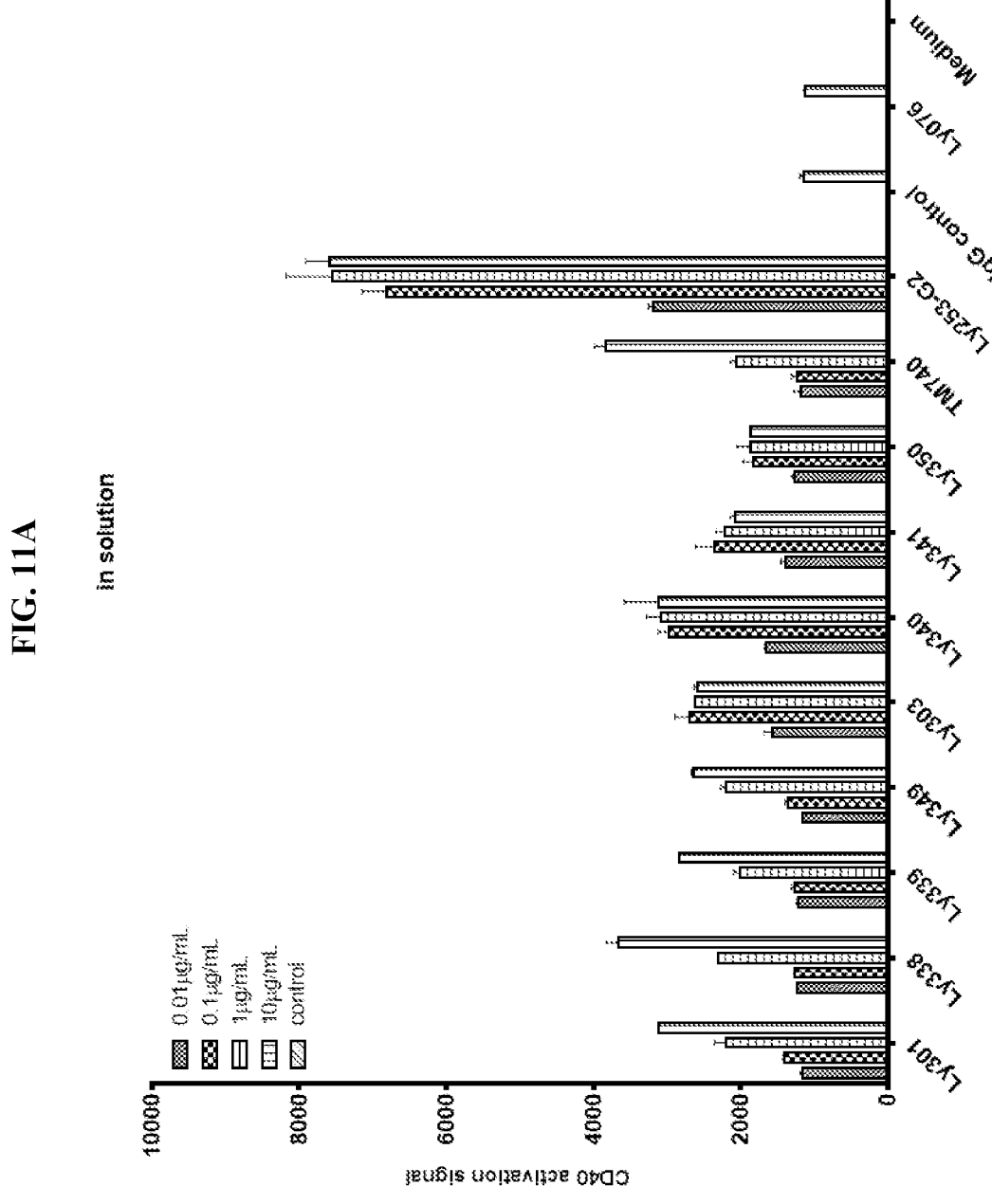
FIGS. 11A-11D are charts showing stimulation of human CD40 activation as indicated by IL8 secretion in a reporter assay by a number of anti-PD-L1/CD40 antibodies. The agonistic activity of these bispecific antibodies was evaluated either in solution, or co-cultured with PD-L1 overexpressing CHO cells. The various antibodies are indicated on the x-axis, and the CD40 activation signal are indicated on the y-axis. The bars labeled as "IgG control" and "Mediun" served as controls. 11A: Clones Ly301, Ly338, Ly339, Ly349, Ly303, Ly340, Ly341, Ly350, TM740, Ly253-G2 and Ly076 were in solution at various concentrations as indicated. 11B: Clones Ly301, Ly338, Ly339, Ly349, Ly303, Ly340, Ly341, Ly350, TM740, Ly253-G2 and Ly076 were cocultured with PD-L1 overexpressing CHO-K1 cells at various concentrations as indicated. 11C: Clones Ly342, Ly343, Ly344, Ly345, TM740, Ly253-G2 and Ly076 were in solution at various concentrations as indicated. 11D: Clones Ly342, Ly343, Ly344, Ly345, TM740, Ly253-G2 and Ly076 were cocultured with PD-L1 overexpressing CHO-K1 cells at various concentrations as indicated.
Figure 11B:
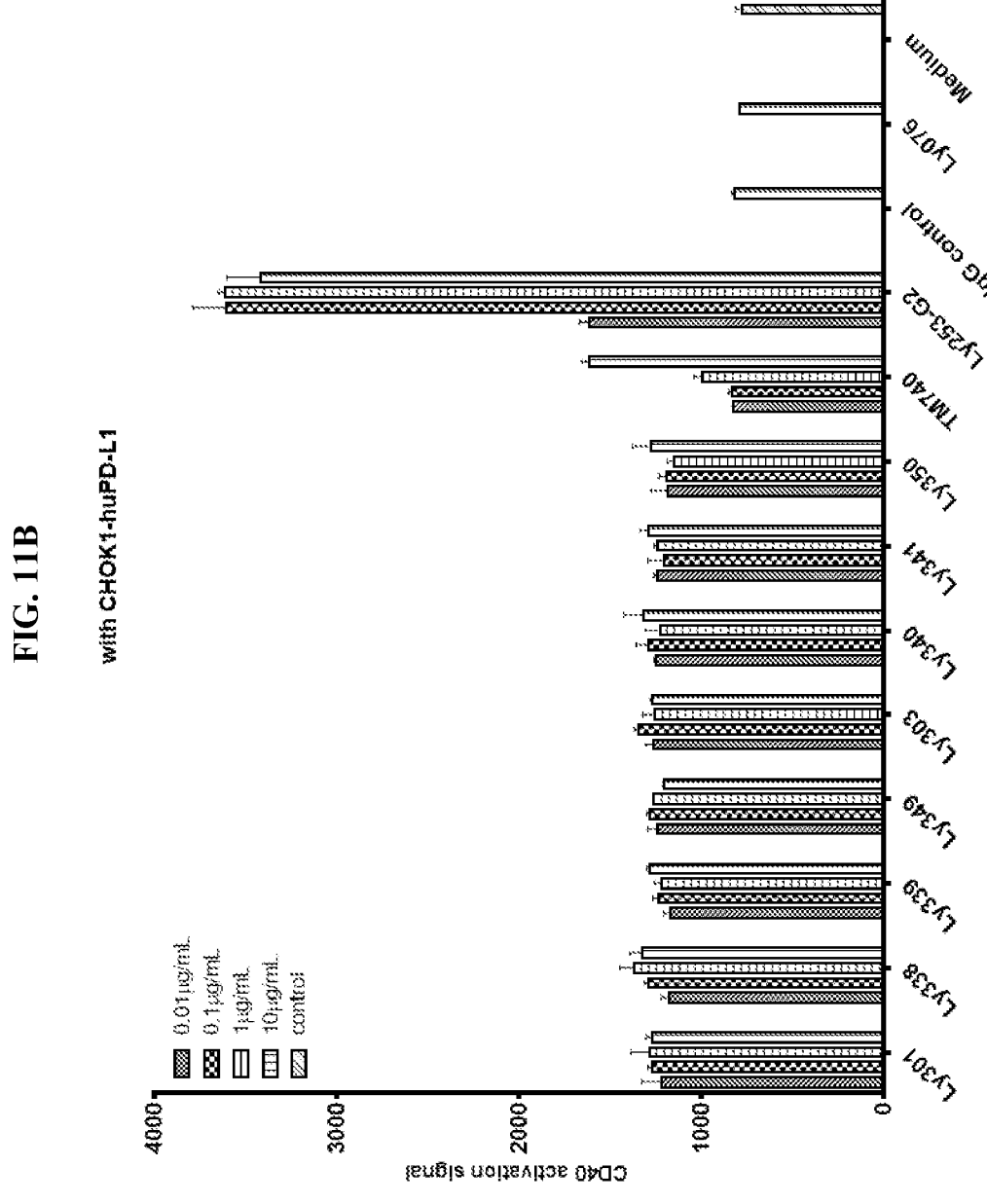
Figure 11C:
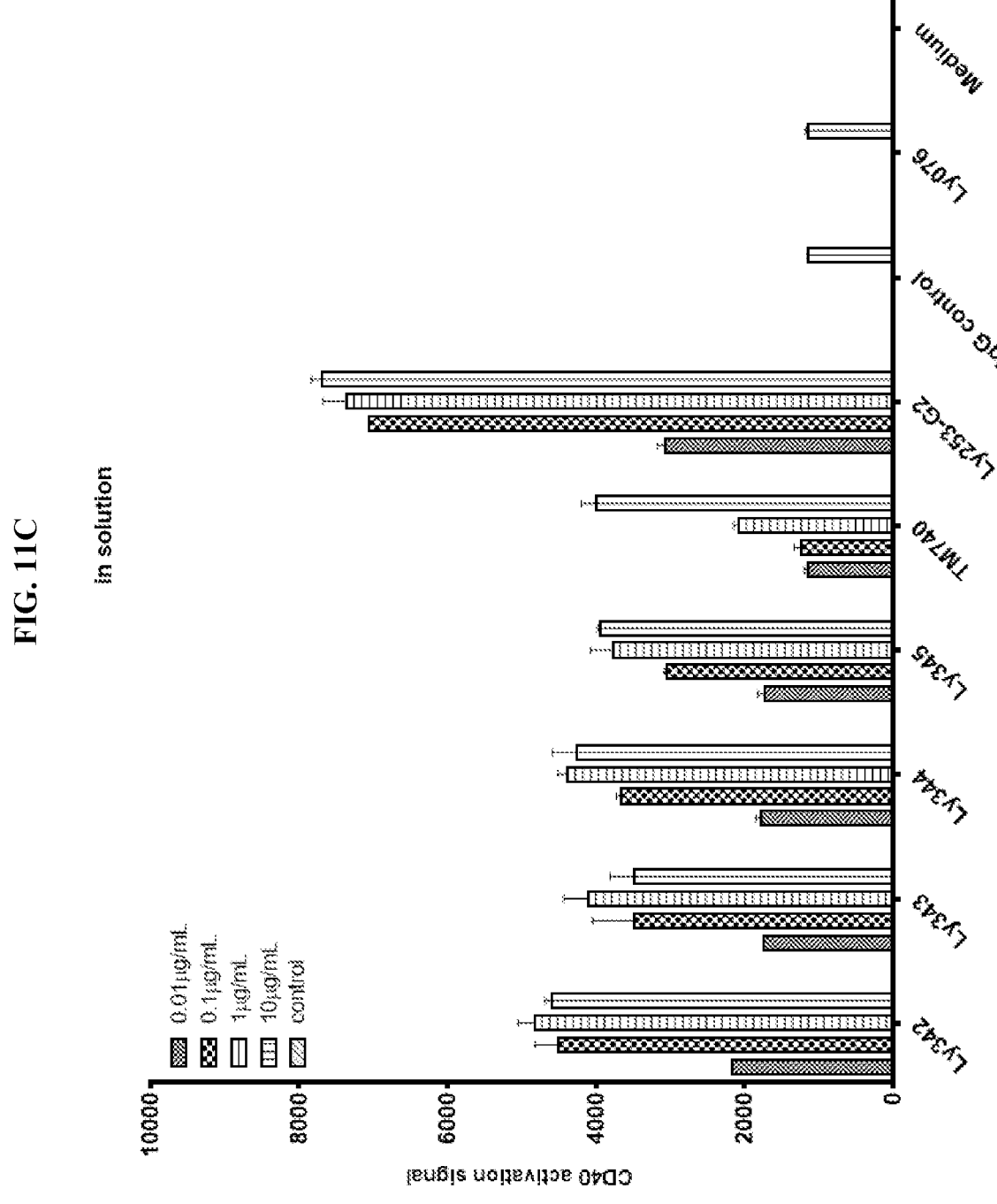
Figure 11D:
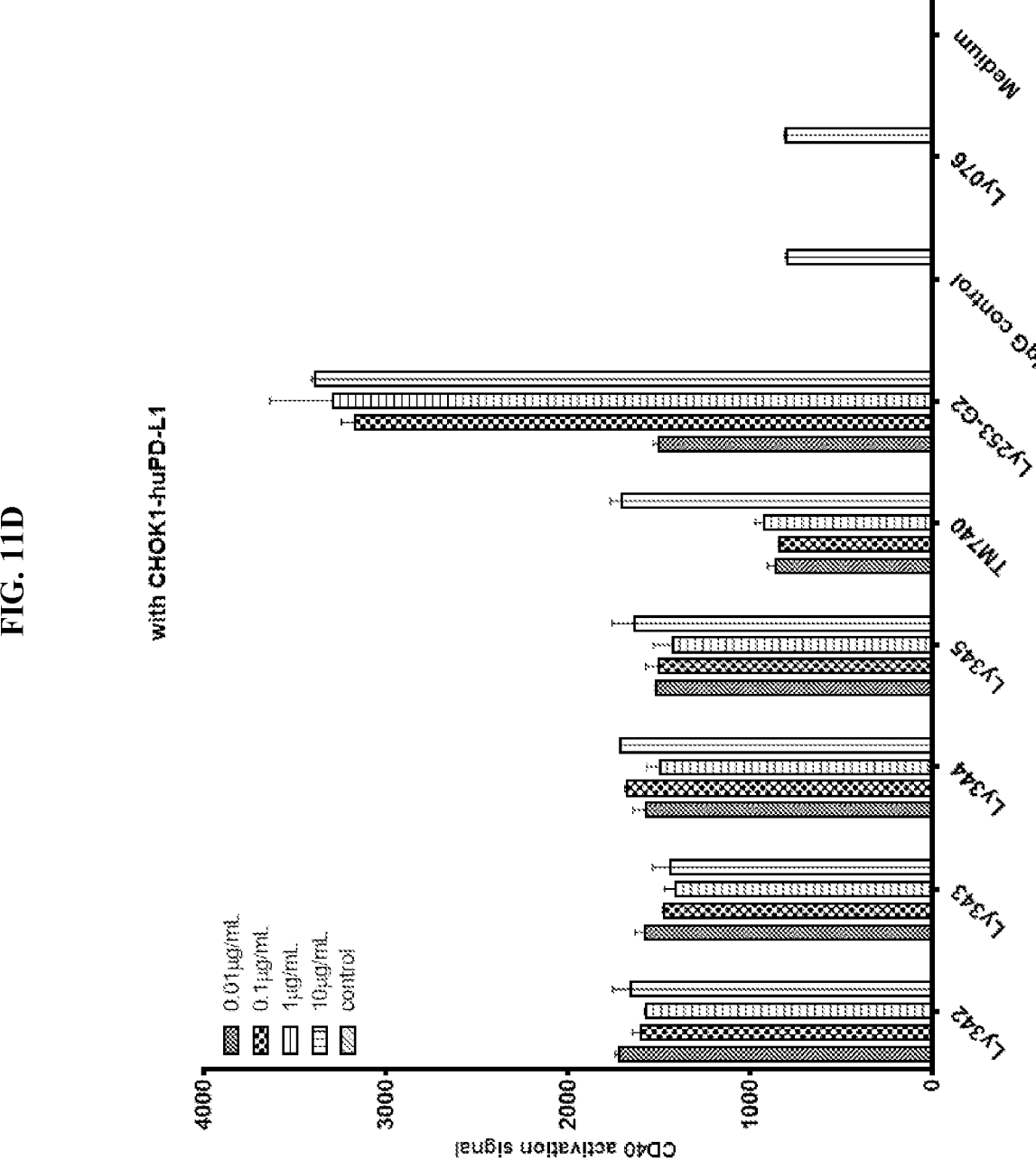

As shown in FIGS. 8A and 8B, the exemplary anti-PD-L1/CD40 bi-specific antibodies exhibited similar binding affinity to human PD-L1 expressed on the CHO cells overexpressing such as Ly076. As shown in FIGS. 9A and 9B, the bi-specific antibodies exhibited binding affinity to human CD40 expressed on CHO cells. Compared to the corresponding parental antibody, the binding activity of bi-specific antibodies comprising scFv formats of the CD40 antibodies remain minimally changed.

Exemplary anti-PD-L1/CD40 bi-specific antibodies were analyzed by ELISA for their simultaneous binding to recombinant human PD-L1 and human CD40. Briefly, Ly090 (human CD40 ECD protein with His tag) was diluted and coated onto an ELISA plate with a volume of 100 µL/well by incubation at 4° C. overnight. The next day, the plate was blocked by PBST-BSA buffer, then serially diluted samples of anti-PD-L1/CD40 bi-specific antibodies were pipetted into appropriate wells at 50 µL/well, and the plate was incubated for 1 h followed by Washing. Human PD-L1 ECD protein (mouse IgG2a Fc tag) was added into the plate at 50 µL/well. After 1-hour incubation at room temperature, HRP-conjugated anti-Mouse IgG, Fc G2a antibody was added into the plate at 100 µL/well. The plate was incubated for 1 hour at room temperature followed by washing. TMB substrate solution was added at 100 µL/well and the color development was stopped by adding 100 µL/well Stop Solution (2N $H_2SO_4$). Absorbance at 450 nm and 620 nm was read by Tecan F200 Pro plate reader. GraphPad 7.0, "[Agonist] vs. response—Variable slope (four parameters)" was used to plot the binding data and calculate binding EC50 values.

As shown in FIGS. 10A-10L, the exemplary anti-PD-L1/CD40 bi-specific antibodies simultaneously binded to recombinant human CD40 and human PD-L1.

(ii) Agonistic Activity for CD40

The CD40 reporter assay disclosed herein was used to determine the agonist activity of the bispecific antibodies, following the same procedures disclosed in Example 2 above. The CD40 reporter assay was also performed in co-culture with PD-L1-expressing CHO cells.

As shown in FIGS. 11A-11D, the bi-specific antibodies in solution showed a various degree of CD40 agonist activity. The agonist activity was greatly enhanced in the co-culture assay, as indicated by the saturation of dose response where lowest concentration of 0.01 µg/mL bispecific antibodies exhibited maximal activity. Binding to both CD40 and PD-L1 by the tested bi-specific antibodies simultaneously in a microenvironment would affect individual binding due to the avidity effect, which refers to the accumulated strength of multiple affinities of individual non-covalent binding interactions. The bi-specific antibodies showed increased activity when co-cultured with PD-L1-expressing CHO cells. Therefore, binding profile to human PD-L1 and CD40 would affect the agonist activity of these bi-specific antibodies.

(iii) Blockage of PD-1/PD-L1 Interaction

The PD-1 reporter assay disclosed herein was used to determine the ability of the bi-specific antibodies in blocking PD-L1/PD-1 cellular function, following the same procedures disclosed in the section of "Characterization of anti-PD-L1 antibodies" above. The anti-PD-L1 antibody Ly076 was used as a reference.

Figure 12A:
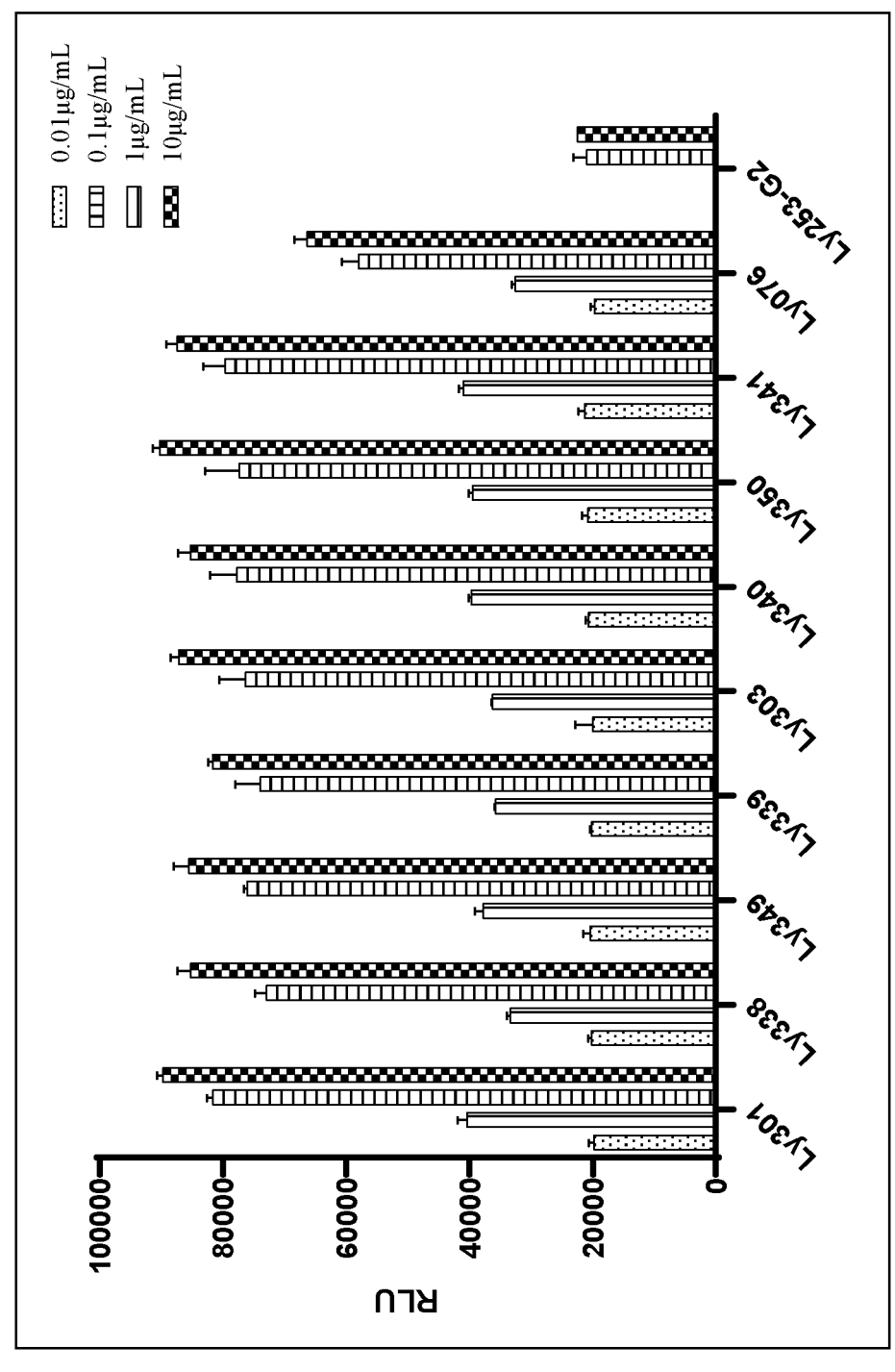
FIGS. 12A-12B are charts showing the PD-1/PD-L1 pathway blocking effect of exemplary anti-PD-L1/anti-CD40 bispecific antibodies. The antibodies are indicated on the x-axis, and the RLU signal on the y-axis reflects the blockade of PD-1/PD-L1 interaction leading to increased signal (e.g., PD-1 activation). 12A: blocking effects of exemplary clones Ly301, Ly338, Ly349, Ly340, Ly350, Ly341, Ly253-G2 and Ly076. 12B: blocking effects of exemplary clones Ly342, Ly344, Ly343, Ly345, Ly253-G2 and Ly076.
Figure 12B:
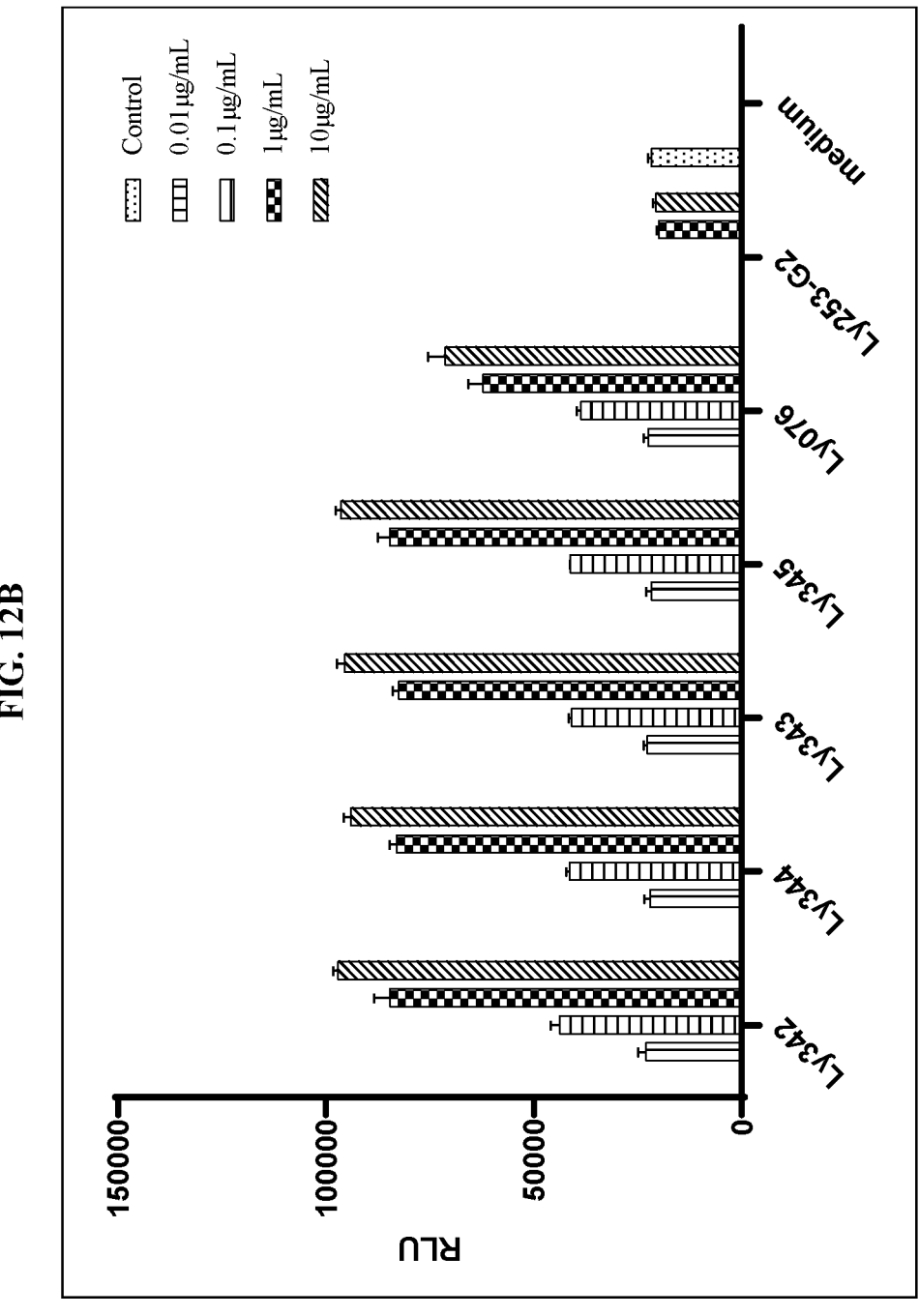

As shown in FIGS. 12A and 12B, the exemplary bi-specific antibodies showed potent and similar blocking activity.

(iv) Immune Cell Activation

Immune cell assays were performed to show the functionality of the bispecific antibodies. Briefly, normal healthy human PBMC (from two donors 1 and 2) were activated with SEB and testing antibodies for 5 days in 6-well plates.

Figure 13A:
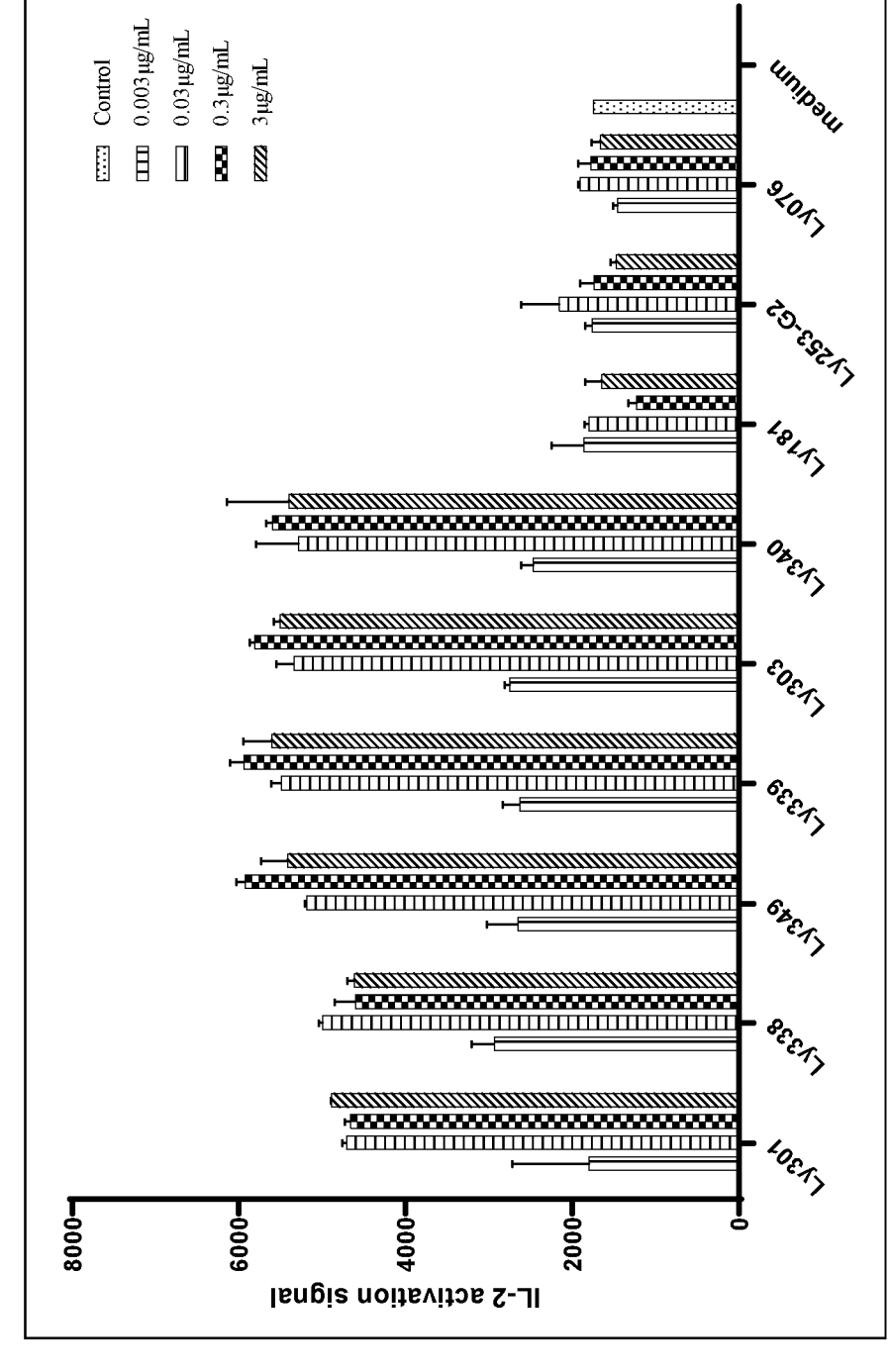
FIGS. 13A-13B are charts showing the stimulation activity of exemplary anti-PD-L1/CD40 bispecific antibodies on the SEB-activated human PBMCs. The various antibodies are indicated on the x-axis, and the stimulation of human PBMC cells are indicated by the secreation of IL-2 on the y-axis. 13A: IL-2 secretion by PBMC activated with Clones Ly301, Ly338, Ly349, Ly339, Ly303, Ly340, TM559, Ly253-G2, Ly076 and Tecentriq. 13B: IL-2 production by PBMC activated with Clones Ly350, Ly341, Ly344, Ly343, Ly345, TM559, Ly253-G2 and Ly076. The activation effects achieved by certain bispecific antibodies (e.g., Ly301, Ly338, Ly349, Ly339, Ly303, and Ly340) were not observed using the parent anti-PD-L1 or anti-CD40 antibodies.
Figure 13B:
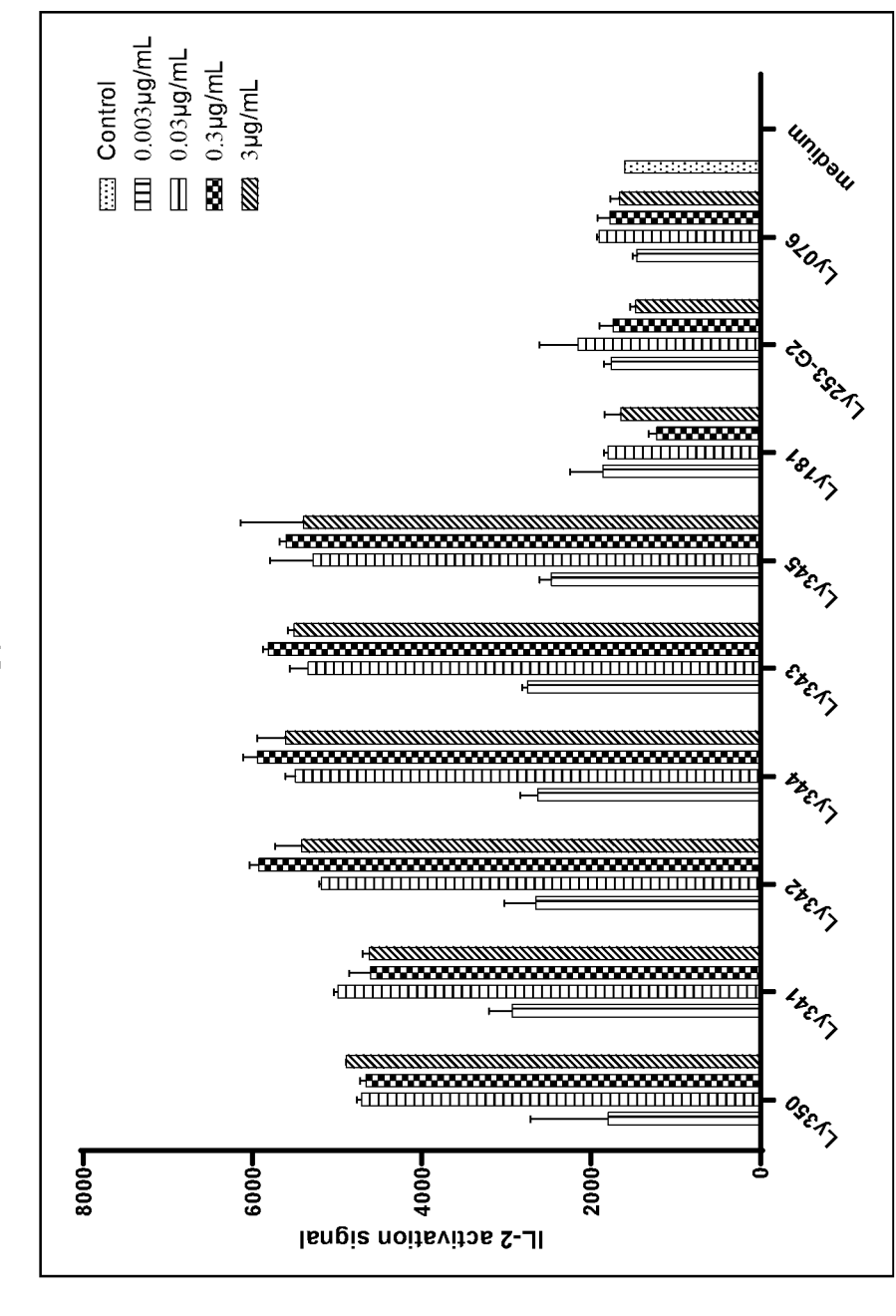

To evaluate CD40 agonist activity and the resulting IL-2 production, $2 \times 10^5$ PBMCs in 100 µL culture medium added SEB (final concentration at 0.01 µg/mL) and serial diluted antibody samples in 100 µL culture medium were added to plates and incubated at 37° C. with 5% $CO_2$ for 5 days. Cell culture supernatants were collected for cytokine detection after 5 days stimulation using Human IL-2 detection kit (Cisbio, Cat #62HIL02PEH) following the instruction manual. FIGS. 13A and 13B show that the exemplary bispecific antibodies induced stronger IL-2 production from human PBMCs than anti-PD-L1 (Ly076) or anti-CD40 (Ly181, Ly253-G2) mAb clones. Therefore, concurrent binding to CD40 and PD-L1 by bi-specific antibodies as exemplified herein in a microenvironment would enhance PBMC stimulation activity as compared with their parental mAbs.

(v) B Cell Proliferation

Anti-PD-L1/CD40 bispecific antibodies were evaluated for the activity to stimulate the proliferation of human B cells. Briefly, human B cells were isolated from human PBMCs using B cell enrichment kit from Stemcell, then resuspended in RPMI1640/10% FBS medium and further aliquoted 100 µL per well into a 96-well cell culture plate.

100 μL of the bi-specific antibodies or corresponding IgG control are added to the cell-containing wells to obtain final concentrations of 0.1 μg/mL to 10 μg/mL. After incubation for 3 days in a 37° C. 5% $CO_2$ incubator, the proliferation of B cells was determined by CellTiter-Glo kit from Promega, #G7582.

Figure 14A:
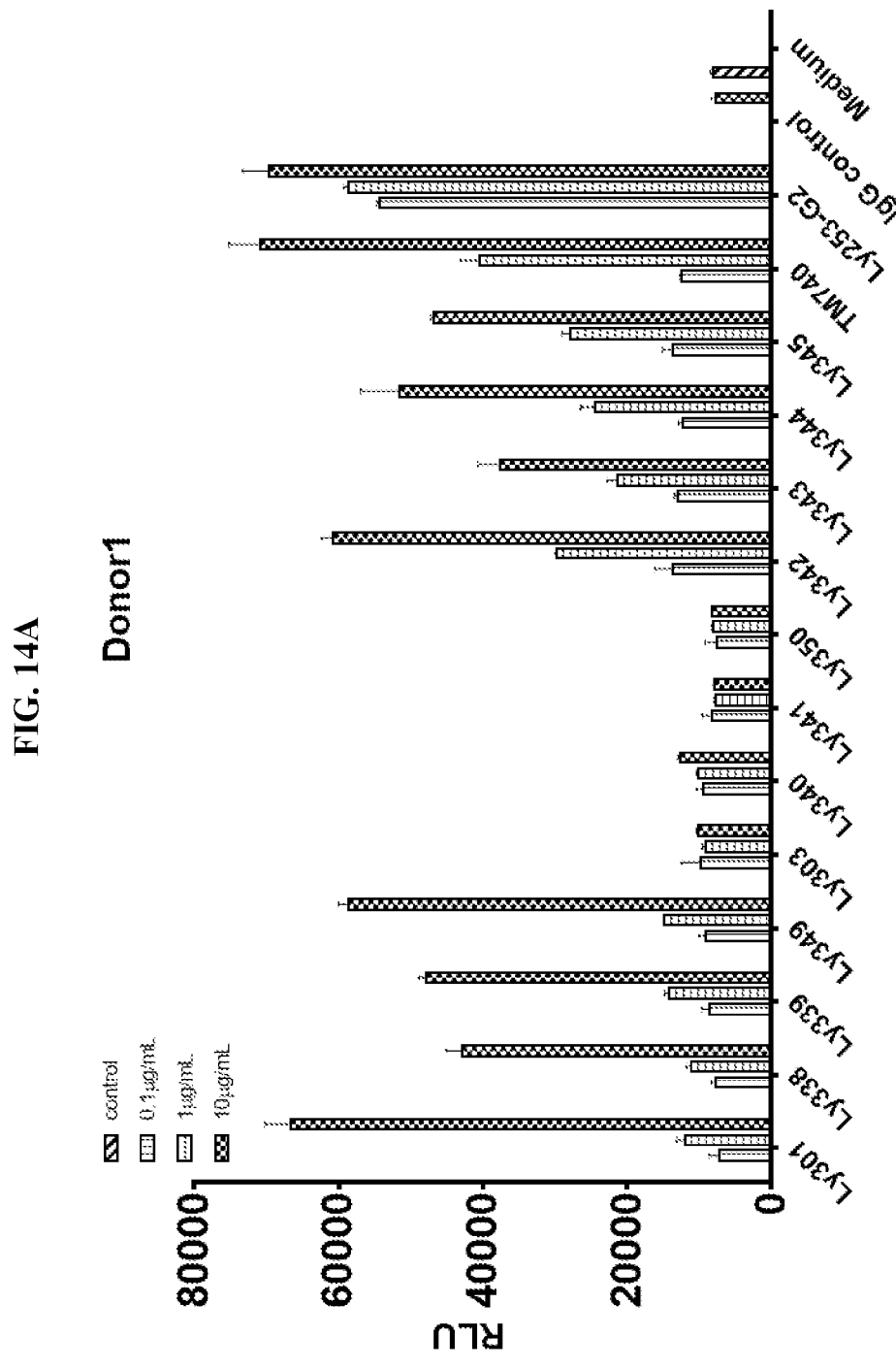
FIGS. 14A-14B are charts showing the activity of a number of anti-PD-L1/CD40 bispecific antibodies on the proliferation of human B cells from two healthy donors. The various antibodies are indicated on the x-axis, and the proliferation of human B cells are indicated by the signal of luminescence (RLU) on the y-axis. 14A: donor 1. 14B: donor 2.
Figure 14B:
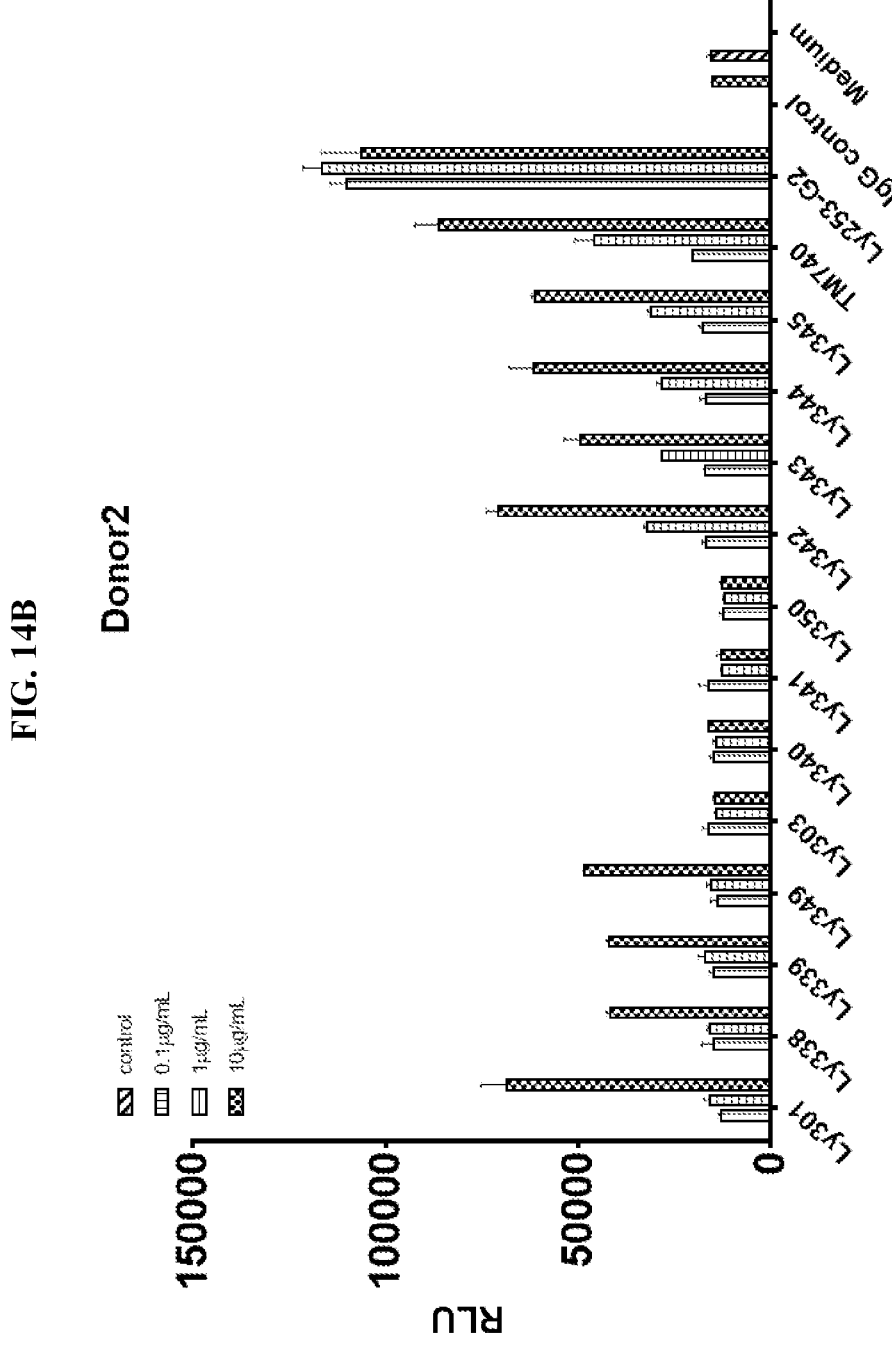

As shown in FIGS. 14A-14B, these exemplary bi-specific antibodies exhibited distinct profile on the proliferation of B cells. It is of interest to note that bi-specific antibodies Ly303, Ly340, Ly341 and Ly350 showed no stimulation of B cell proliferation.

(vi) Dendritic Cell Activation

The anti-PD-L1/CD40 antibodies were tested in vitro for CD40 binding activities and agonistic activity as described in above. Their activities in activating human dendritic cells were carried out as follows.

Frozen human PBMC from healthy donors (Allcells, Cat #PB005F) were thawed and used for monocytes isolation (EasySep™ Human CD14 Positive Selection Kit II Stemcell, Cat: 17858) Differentiation of CD14+ monocytes into dendritic cells was induced by GM-CSF and IL-4 following the standard process.

To perform DC activation assay, the cell density was adjusted to $1\times10^6$/mL. 0.05 mL cell suspension was added to 96 well plate, $5\times10^4$ cells/well. Serial diluted antibody samples were added to plates and incubated at 37° C. with 5% $CO_2$ for 24 hours. Cell culture supernatants were collected for cytokine detection using huIL-8 detection kit (Cisbio, Cat #: 62HIL08PEH) in the cell culture supernatant 24 h later. The DC activation assay was also performed in co-culture with PD-L1 expressing CHO cells.

Figure 15A:
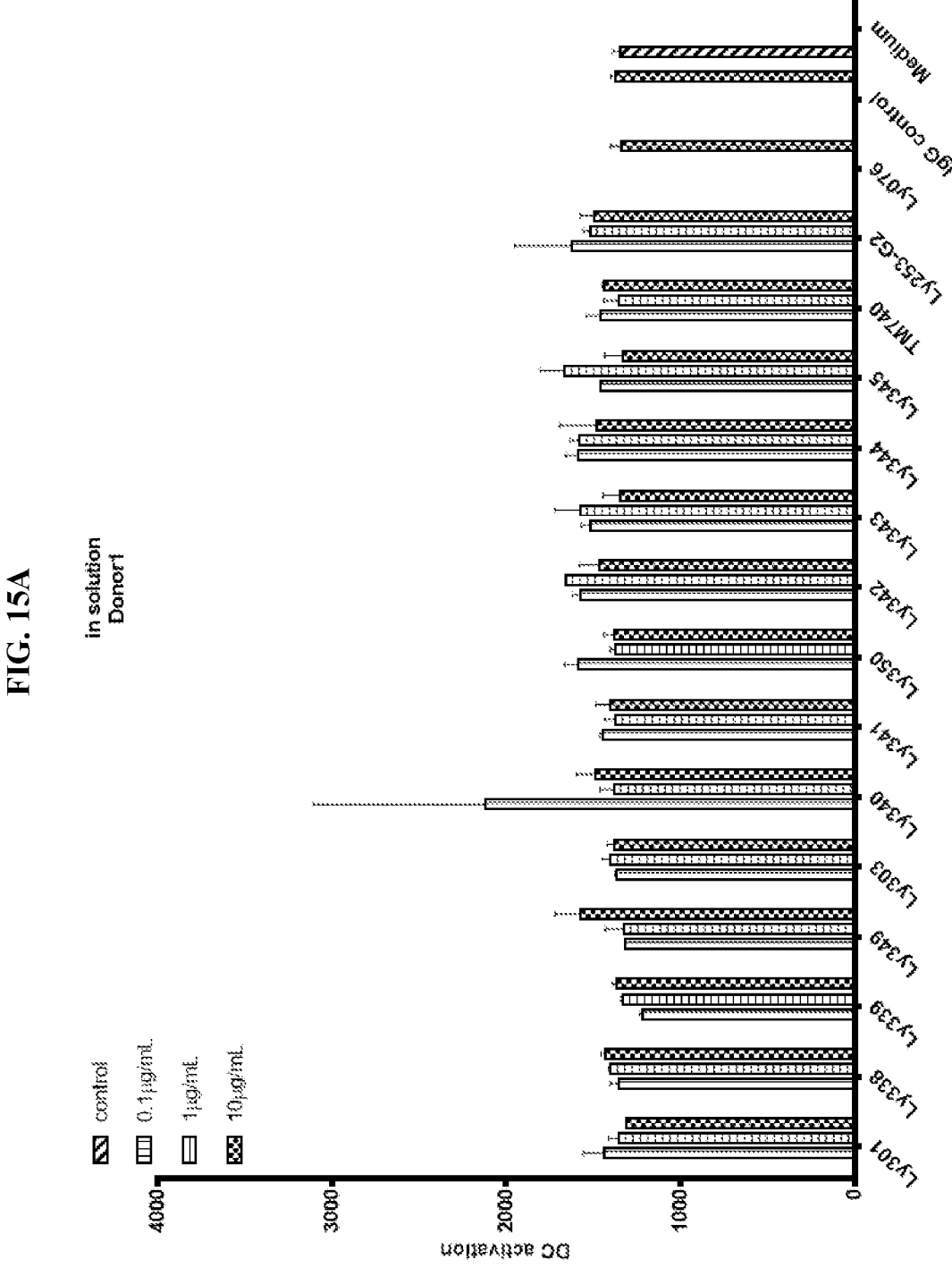
Figure 15B:
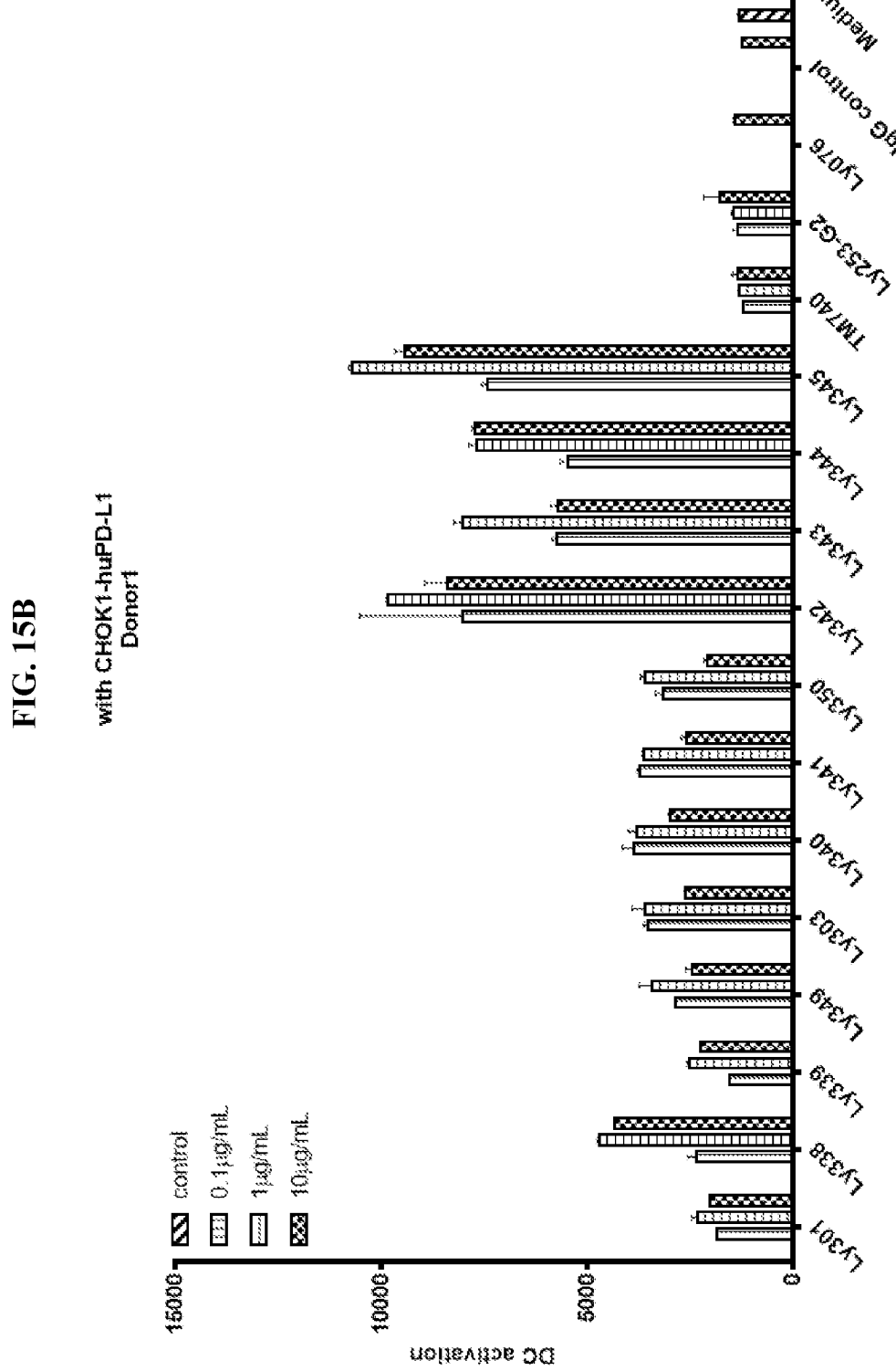
Figure 15C:
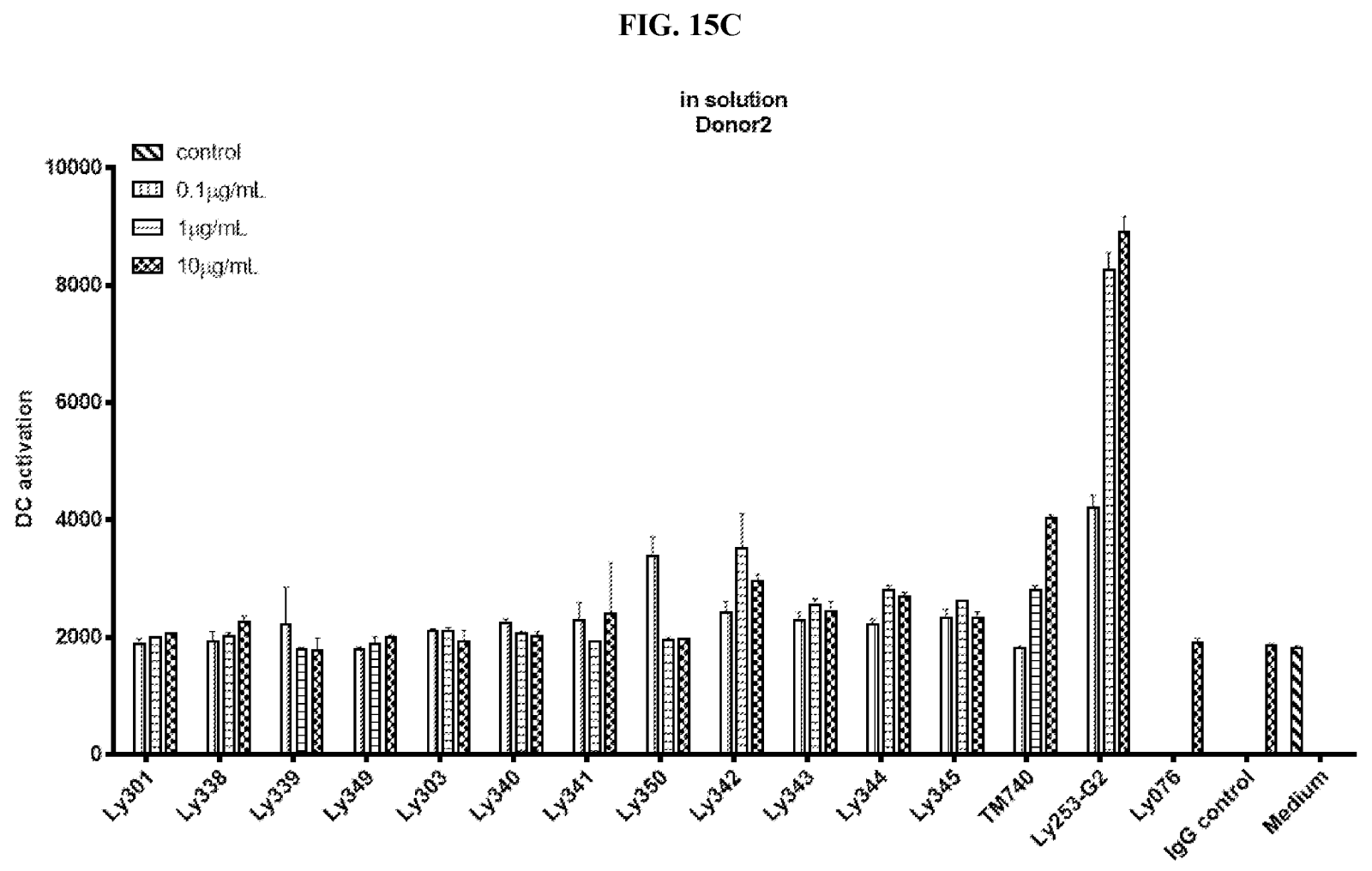
Figure 15D:
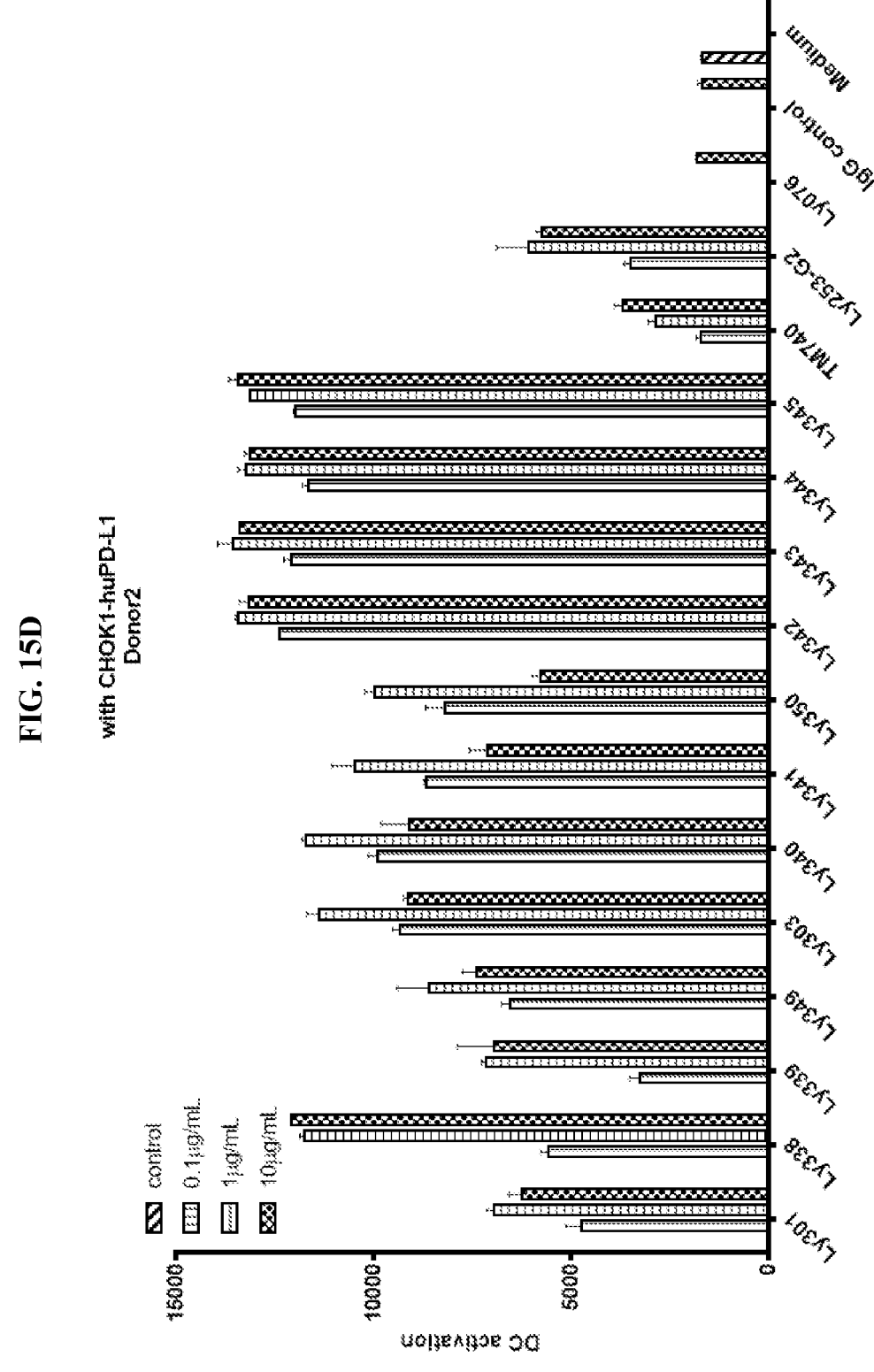

As shown FIGS. 15A-15D, the tested anti-PD-L1/CD40 antibodies stimulated DC activation at various degrees as evidenced by the secretion of IL8 from the DC culture after antibody incubation. The magnitude of DC activation was increased in the co-culture assay with both donors (FIGS. 15B and 15D) as compared to the assays for antibodies in solution (FIGS. 15A and 15C). Binding to CD40 and PD-L1 by antibody molecules simultaneously in a microenvironment would affect individual binding due to avidity effect leading to alteration of CD40 agonistic effect of the antibodies. The results indicate that the bispecific antibodies showed much higher DC activation activity as compared with anti-CD40 mAbs.

(vii) Pharmacokinetic Studies of Anti-PD-L1/CD40 Bi-Specific Antibodies

C57BL/6 mice (6-7 weeks old, 19-20 g, male, purchased from SLAC Laboratory Animal Co. LTD) were used for the study. Antibodies were formulated in PBS and administered via tail vein injection at 3 mg/kg in a group of 4 mice.

Figure 16A:
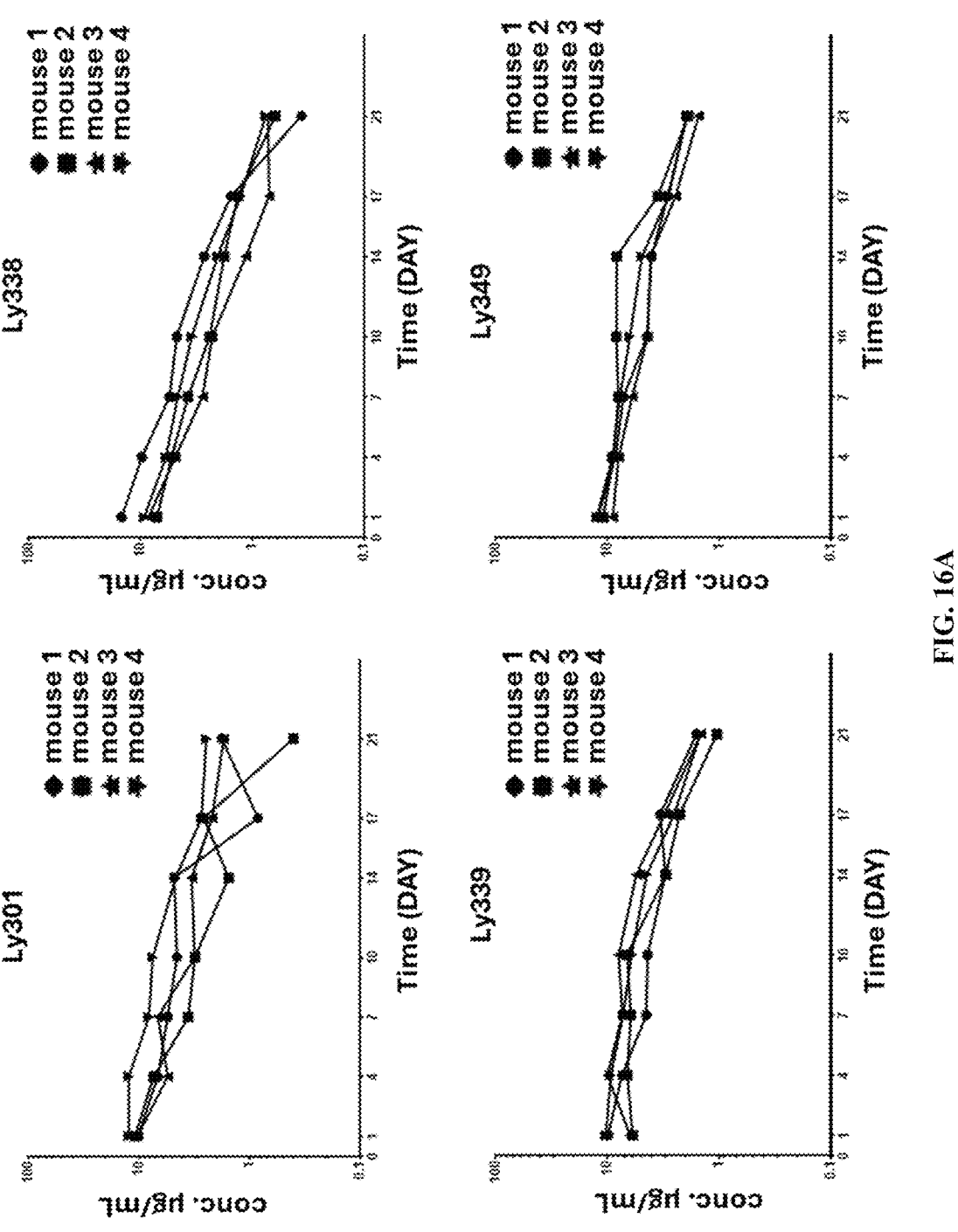
FIGS. 16A-16C include a set of graphs showings pharmacokinetics of anti-PD-L1/CD40 bispecific antibodies as indicated in mice. 16A: Clones Ly301 (left top), Ly338 (right top), Ly339 (left bottom) and Ly349 (right bottom). 16B: Clones Ly303 (left top), Ly340 (right top), Ly341 (left bottom) and Ly350 (right bottom). 16C: Clones Ly342 (left top), Ly343 (right top), Ly344 (left bottom) and Ly345 (right bottom).
Figure 16B:
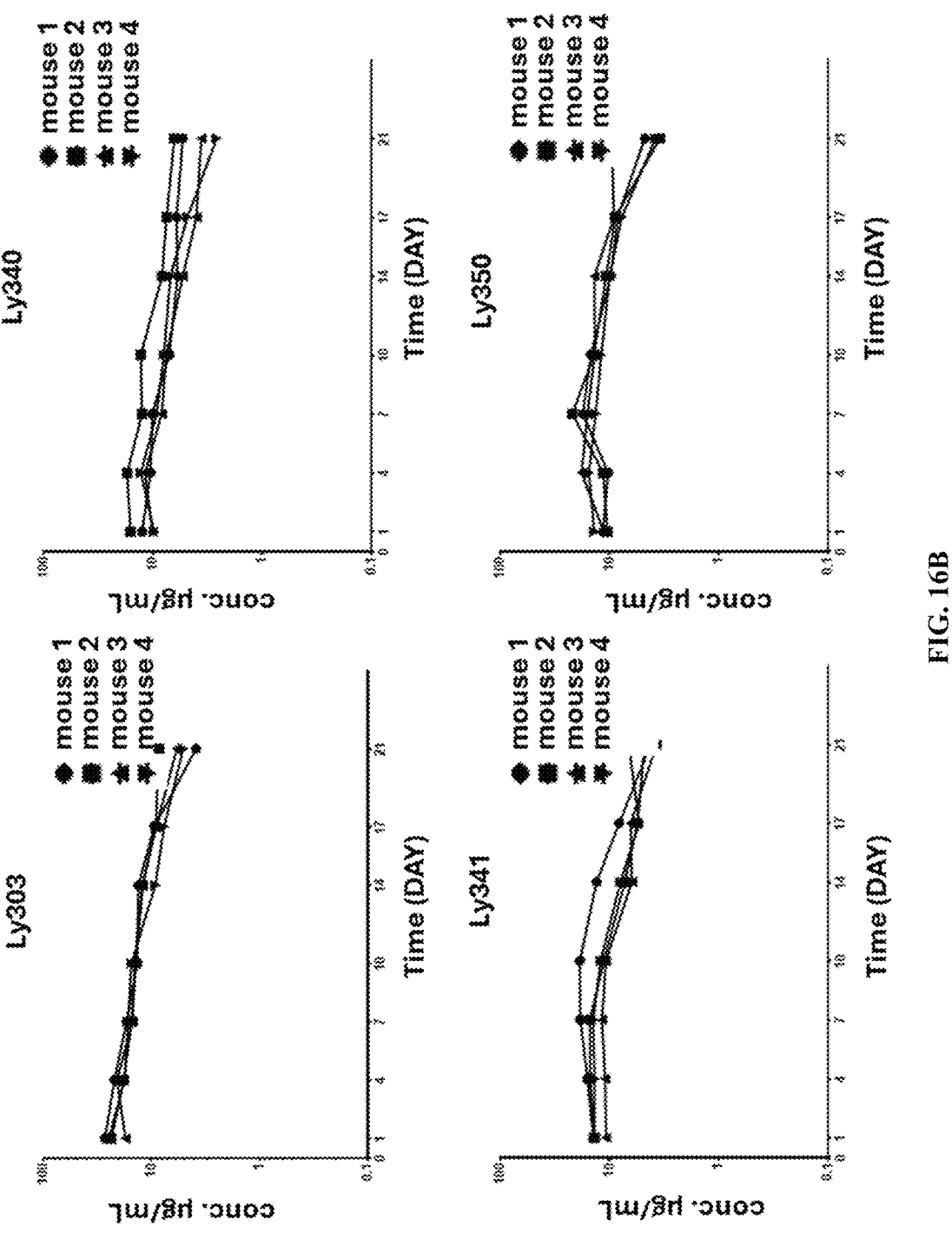
Figure 16C:
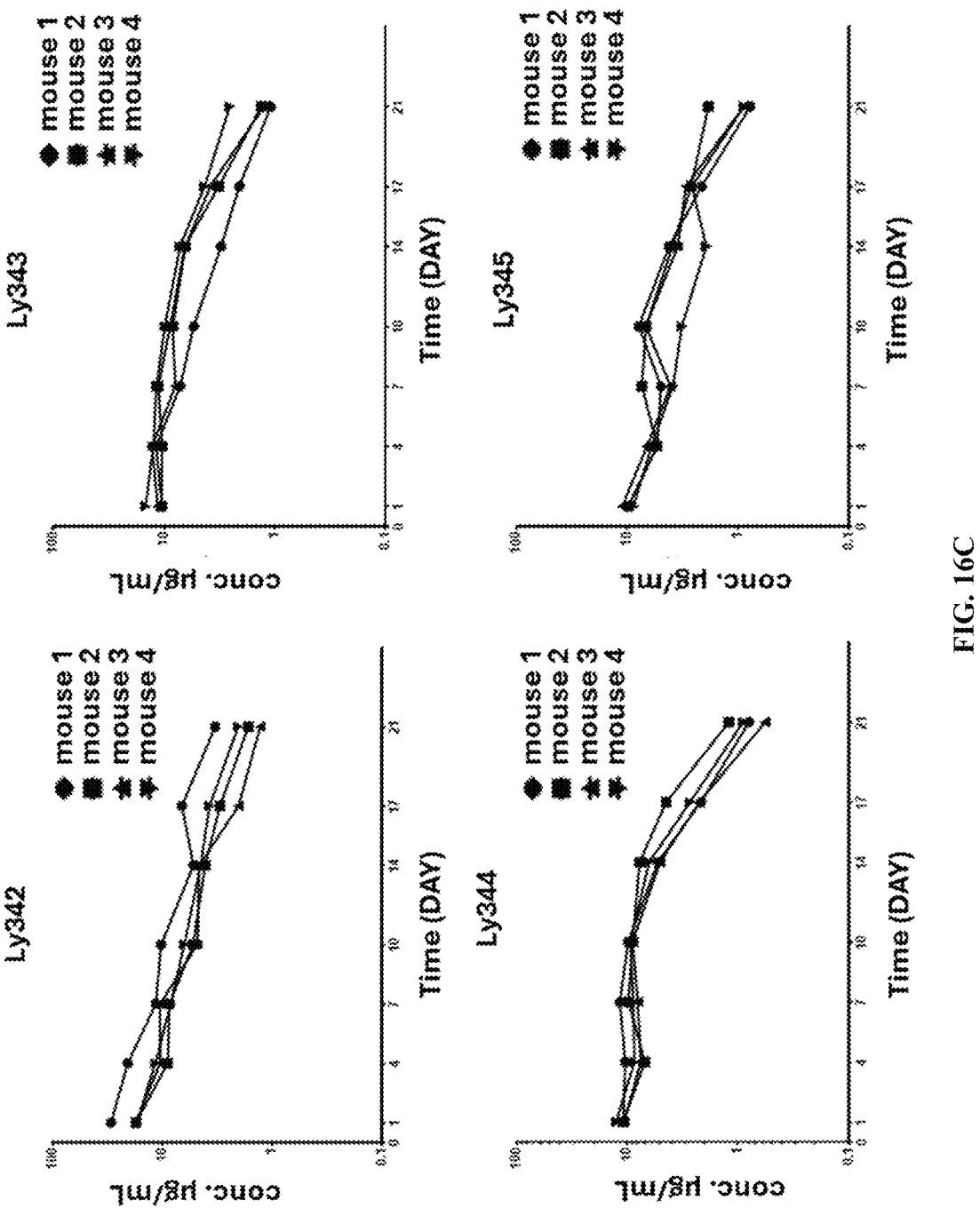

Blood sampling was done at pre-dose, 1d, 4d, 7d, 10d, 14d, 17d and 21d by serial bleeding. 10 μL blood per time point was added to 40 μL of a PBS-BSA solution. The sample was then mixed well and centrifuged at 2000 g for 5 minutes at 4° C. The supernatant was put on dry ice immediately after collection and stored at approximately −70° C. until analysis. Blood antibody concentrations were determined by ELISA. FIGS. 16A-16C showed the blood concentrations of the bispecific antibodies after a single intravenous injection of 3 mg/kg. These bispecific antibodies showed high and lasting circulation concentrations.

(viii) Anti-Tumor Activity

Exemplary anti-PD-L1/CD40 antibodies were tested in mouse syngeneic tumor models in vivo to determine the anti-tumor efficacy and toxicity of these antibodies. Human PD-L1 overexpressing murine colon cancer MC38 tumor cells were subcutaneously implanted into homozygous human CD40 knock-in C57BL6 mice. Mice were grouped when the tumor size was approximately 150±50 mm³ (n=6). Anti-PD-L1/CD40 antibodies were administered by intraperitoneal injections and tumor sizes were measure during 4-6 weeks of antibody treatment. Tumor sizes were calculated as tumor volume using formula of 0.5×length×width².

Figure 17A:
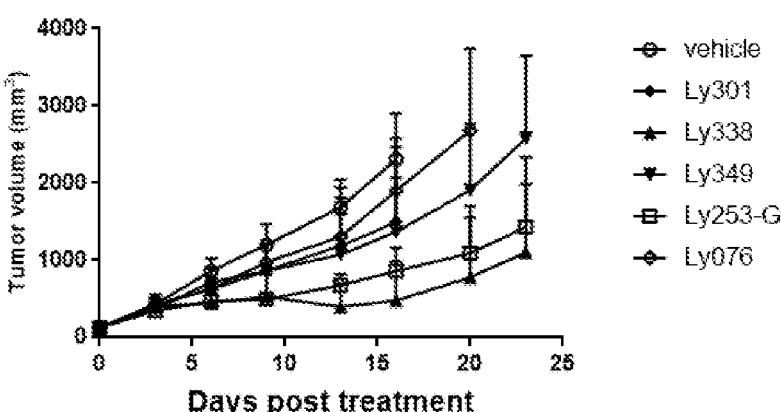
FIGS. 17A-17C are a set of graphs showing the anti-tumor activity of anti-PD-L1/CD40 antibodies in a human CD40 knock-in mouse syngeneic model with human PD-L1 overexpressing MC38 tumor cells. 17A: anti-tumor effects of clones Ly301, Ly338, Ly349, Ly253-G2 and Ly076. 17B: anti-tumor effects of clones Ly303, Ly340, Ly341, Ly253-
Figure 17B:
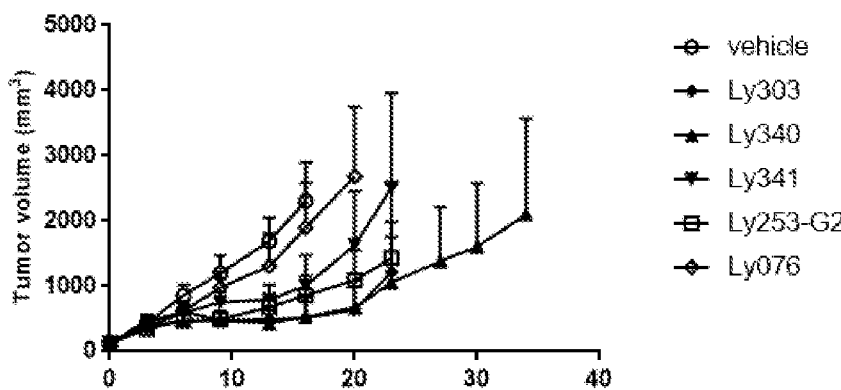
Figure 17C:
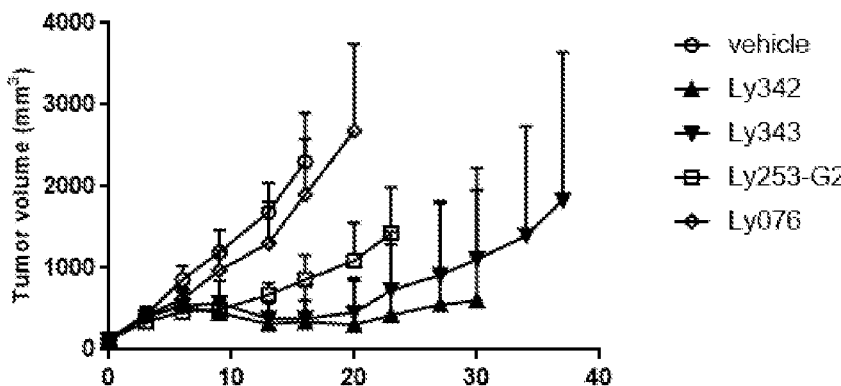

Anti-tumor efficacy was evaluated between tumor sizes of the control group and antibody treatment group as shown in FIGS. 17A-17C. Antibody Ly253-G2 showed antitumor efficacy while inducing serum ALT elevation. Several of the bispecific antibodies including Ly338, Ly303, Ly340, Ly341, Ly342 and Ly343 showed comparable or stronger efficacy relative to Ly253-G2. Furthermore, Ly338, Ly303, Ly340, and Ly342 did not cause apparent elevation of serum ALT (FIG. 18).

Example 4: Anti-B7H4/CD40 Bi-Specific Antibodies

Preparation Anti-B7H4 Antibodies

Anti-human B7H4 antibodies were generated using standard murine hybridoma technology. The amino acid sequences of exemplary anti-B7H4 antibodies, Ly361 (hybridoma 14D3) and Ly366 (hybridoma 25F3), were analyzed and their CDRs were identified following the Kabat CDR definitions. The VH and VL sequences of Ly361 and Ly366 are provided below with CDR regions highlighted in boldface. The chimeric antibodies comprising human IgG1 constant region were prepared and confirmed to show high affinity binding to B7H4.

```
>Ly361_VH (SEQ ID NO: 45)
EVQLVESGGDLVKPGGSLKLSCAASGFTFSSYGMSWVRQTPDKRLEW

VAAISTGGSYTYYPDSVKGRFTISRDTATNTLYLQMSTLKSEDTAMY

YCTRRGATGSWFAYWGQGTLVTVSA

>Ly361_VL (SEQ ID NO: 46)
DILMTQSPSSMSVSLGDTVSITCHASQGINNNIGWLQRKPGKSFKGL

IYHGTNLEDGVPSRFSGSGSGADYSLTISSLESEDFADYYCVQYVQF

PRTFGGGTKLEIKR

>Ly366_VH (SEQ ID NO: 47)
EVQLVESGGGLVKPGGSLKLSCAASGFTFSDSGMHWVRQAPEKGLEW

ITYINSGSSTIYYADSVKGRFTISRDNAKNTLFLQMTSLRSEDTAMY

YCARGRGYAMDYWGQGTSVTVSS

>Ly366_VL (SEQ ID NO: 48)
EIVLTQSPTTMAASPGEKITIFCSASSSISSDFLHWYQQKPGFSPKL

LIYRISNLASGVPARFSGSGSGTSYSLTIGTMEAEDVATYYCQQGSN

VPRTFGGGTKLEIKR

Ly361 (chimeric)
Heavy chain (SEQ ID NO: 123):
EVQLVESGGDLVKPGGSLKLSCAASGFTFSSYGMSWVRQTPDKRLEW

VAAISTGGSYTYYPDSVKGRFTISRDTATNTLYLQMSTLKSEDTAMY

YCTRRGATGSWFAYWGQGTLVTVSAASTKGPSVFPLAPSSKSTSGGT

AALGCLVKDYFPEPVTVSWNSGALTSGVHTFPAVLQSSGLYSLSSVV

TVPSSSLGTQTYICNVNHKPSNTKVDKKVEPKSCDKTHTCPPCPAPE

LLGGPSVFLFPPKPKDTLMISRTPEVTCVVVDVSHEDPEVKFNWYVD
```

-continued
GVEVHNAKTKPREEQYNSTYRVVSVLTVLHQDWLNGKEYKCKVSNKA

LPAPIEKTISKAKGQPREPQVYTLPPSREEMTKNQVSLTCLVKGFYP

SDIAVEWESNGQPENNYKTTPPVLDSDGSFFLYSKLTVDKSRWQQGN

VFSCSVMHEALHNHYTQKSLSLSPGK

Light chain (SEQ ID NO: 124):
DILMTQSPSSMSVSLGDTVSITCHASQGINNNIGWLQRKPGKSFKGL

IYHGTNLEDGVPSRFSGSGSGADYSLTISSLESEDFADYYCVQYVQF

PRTFGGGTKLEIKRTVAAPSVFIFPPSDEQLKSGTASVVCLLNNFYP

REAKVQWKVDNALQSGNSQESVTEQDSKDSTYSLSSTLTLSKADYEK

HKVYACEVTHQGLSSPVTKSFNRGEC

Ly366 (chimeric)
Heavy chain (SEQ ID NO: 125):
EVQLVESGGGLVKPGGSLKLSCAASGFTFSDSGMHWVRQAPEKGLEW

ITYINSGSSTIYYADSVKGRFTISRDNAKNTLFLQMTSLRSEDTAMY

YCARGRGYAMDYWGQGTSVTVSSASTKGPSVFPLAPSSKSTSGGTAA

LGCLVKDYFPEPVTVSWNSGALTSGVHTFPAVLQSSGLYSLSSVVTV

PSSSLGTQTYICNVNHKPSNTKVDKKVEPKSCDKTHTCPPCPAPELL

GGPSVFLFPPPKPKDTLMISRTPEVTCVVVDVSHEDPEVKFNWYVDGV

-continued
EVHNAKTKPREEQYNSTYRVVSVLTVLHQDWLNGKEYKCKVSNKALP

APIEKTISKAKGQPREPQVYTLPPSREEMTKNQVSLTCLVKGFYPSD

IAVEWESNGQPENNYKTTPPVLDSDGSFFLYSKLTVDKSRWQQGNVF

SCSVMHEALHNHYTQKSLSLSPGK

Light chain (SEQ ID NO: 126)
EIVLTQSPTTMAASPGEKITIFCSASSSISSDFLHWYQQKPGFSPKL

LIYRISNLASGVPARFSGSGSGTSYSLTIGTMEAEDVATYYCQQGSN

VPRTFGGGTKLEIKRTVAAPSVFIFPPSDEQLKSGTASVVCLLNNFY

PREAKVQWKVDNALQSGNSQESVTEQDSKDSTYSLSSTLTLSKADYE

KHKVYACEVTHQGLSSPVTKSFNRGEC

Preparation Anti-B7H4/CD40 Bi-Specific Antibodies

Anti-B7H4/CD40 bi-specific antibodies are produced for the human or humanized anti-CD40 antibodies exemplified above. cDNAs encoding the VH and VL chains of the anti-B7H4 antibodies and the VH and VL chains of the anti-CD40 antibodies are used as the starting materials. CHO transient expression was carried out using plasmids configured for expressing the corresponding heavy and light chain sequences. These antibodies were purified by protein A affinity chromatography. The amino acid sequences of the polypeptides of the bi-specific antibodies are provided below:

Ly474
First polypeptide (from N→C terminus, heavy chain of Ly361 with IgG1 mutated Fc
region and scFv of TM740 in VL→VH orientation; SEQ ID NO: 127)
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSLSASVG

DRVTITCKASQNIYIYLNWYQQKPGKAPKLLIYNTNNLQTGVPSRFSGSGSGTDFTLTISSLQPEDFAT

YYCLQHSSRRTFGGGTKVEIKGGGGSGGGGSGGGGSGGGGSQVQLVESGGGLVQPGGSLKLSCATSGFN

FNDYFMNWVRQASGKGLEWVGQIRNKNYNYATYYTESLEGRVTISRDDSKNTAYLQMNSLKTEDTAVYY

CTSYYYDGFADYFDYWGQGTTVTVSS

Second polypeptide: light chain of Ly361 (SEQ ID NO: 124)

Ly475
First polypeptide (from N→C terminus, heavy chain of Ly361 with IgG1 mutated Fc
region and scFv of TM740 in VH→VL orientation; SEQ ID NO: 128)
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSQVQLVESGGGLVQPGG

-continued

SLKLSCATSGFNFNDYFMNWVRQASGKGLEWVGQIRNKNYNYATYYTESLEGRVTISRDDSKNTAYLQM

NSLKTEDTAVYYCTSYYYDGFADYFDYWGQGTTVTVSSGGGGSGGGGSGGGGSGGGGSDIQMTQSPSSL

SASVGDRVTITCKASQNIYIYLNWYQQKPGKAPKLLIYNTNNLQTGVPSRFSGSGSGTDFTLTISSLQP

EDFATYYCLQHSSRRTFGGGTKVEIK

Second polypeptide: light chain of Ly361 (SEQ ID NO: 124)

Ly476
First polypeptide: heavy chain of Ly361 with IgG1 mutated Fc (SEQ ID NO: 129):
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGK

Second polypeptide (from N→C terminus, light chain of Ly361 and scFv of TM740 in
VL-VH orientation; SEQ ID NO: 130)
DILMTQSPSSMSVSLGDTVSITCHASQGINNNIGWLQRKPGKSFKGLIYHGTNLEDGVPSRFSGSGSGA

DYSLTISSLESEDFADYYCVQYVQFPRTFGGGTKLEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSLSASVGDRVTITCKASQNIYIYLNWYQQKPGK

APKLLIYNTNNLQTGVPSRFSGSGSGTDFTLTISSLQPEDFATYYCLQHSSRRTFGGGTKVEIKGGGGS

GGGGSGGGGSGGGGSQVQLVESGGGLVQPGGSLKLSCATSGFNFNDYFMNWVRQASGKGLEWVGQIRNK

NYNYATYYTESLEGRVTISRDDSKNTAYLQMNSLKTEDTAVYYCTSYYYDGFADYFDYWGQGTTVTVSS

Ly477
First polypeptide: heavy chain of Ly476 (SEQ ID NO: 129)

Second polypeptide (from N→C terminus, light chain of Ly361 and scFv of TM740 in
VH→VL orientation; SEQ ID NO: 131)
DILMTQSPSSMSVSLGDTVSITCHASQGINNNIGWLQRKPGKSFKGLIYHGTNLEDGVPSRFSGSGSGA

DYSLTISSLESEDFADYYCVQYVQFPRTFGGGTKLEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSQVQLVESGGGLVQPGGSLKLSCATSGFNFNDYFMNWVRQASG

KGLEWVGQIRNKNYNYATYYTESLEGRVTISRDDSKNTAYLQMNSLKTEDTAVYYCTSYYYDGFADYFD

YWGQGTTVTVSSGGGGSGGGGSGGGGSGGGGSDIQMTQSPSSLSASVGDRVTITCKASQNIYIYLNWYQ

QKPGKAPKLLIYNTNNLQTGVPSRFSGSGSGTDFTLTISSLQPEDFATYYCLQHSSRRTFGGGTKVEIK

Ly478
First polypeptide ((from N→C terminus, heavy chain of Ly361 with IgG1 mutated Fc
region and scFv of TM599 in VL→VH orientation; SEQ ID NO: 132)
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSLSASVG

DRVTITCLASEDISNDLAWYQQKPGKAPKLLIYFVDRLLDGVPSRFSGSGSGTDFTLTISSLQPEDFAT

YYCQQSYKYPPTFGQGTKLEIKGGGGSGGGGSGGGGSGGGGSEVQLVESGGGLVQPGGSLRLSCAASGF

-continued

TFTNYGLHWVRQAPGKGLEWVSSISPSGGVTYYRDSVKGRFTISRDNSKNTLYLQMNSLRAEDTAVYYC

AKPFLGWGGANWIAHWGQGTLVTVSS

Second polypeptide: light chain of Ly361 (SEQ ID NO: 124)

Ly479
First polypeptide ((from N→C terminus, heavy chain of Ly361 and scFv of TM559 in
VH→VL orientation; SEQ ID NO: 133)
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSEVQLVESGGGLVQPGG

SLRLSCAASGFTFTNYGLHWVRQAPGKGLEWVSSISPSGGVTYYRDSVKGRFTISRDNSKNTLYLQMNS

LRAEDTAVYYCAKPFLGWGGANWIAHWGQGTLVTVSSGGGGSGGGGSGGGGSGGGGSDIQMTQSPSSLS

ASVGDRVTITCLASEDISNDLAWYQQKPGKAPKLLIYFVDRLLDGVPSRFSGSGSGTDFTLTISSLQPE

DFATYYCQQSYKYPPTFGQGTKLEIK

Second polypeptide: light chain of Ly361 (SEQ ID NO: 124)

Ly480
First polypeptide: heavy chain of Ly476 (SEQ ID NO: 129)

Second polypeptide ((from N→C terminus, light chain of Ly361 and scFv of TM559
in VL→VH orientation; SEQ ID NO: 134)
DILMTQSPSSMSVSLGDTVSITCHASQGINNNIGWLQRKPGKSFKGLIYHGTNLEDGVPSRFSGSGSGA

DYSLTISSLESEDFADYYCVQYVQFPRTFGGGTKLEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSLSASVGDRVTITCLASEDISNDLAWYQQKPGK

APKLLIYFVDRLLDGVPSRFSGSGSGTDFTLTISSLQPEDFATYYCQQSYKYPPTFGQGTKLEIKGGGG

SGGGGSGGGGSGGGGSEVQLVESGGGLVQPGGSLRLSCAASGFTFTNYGLHWVRQAPGKGLEWVSSISP

SGGVTYYRDSVKGRFTISRDNSKNTLYLQMNSLRAEDTAVYYCAKPFLGWGGANWIAHWGQGTLVTVSS

Ly481
First polypeptide: heavy chain of Ly476 (SEQ ID NO: 129)

Second polypeptide ((from N→C terminus, light chain of Ly361 and scFv of TM559
in VH→VL orientation; SEQ ID NO: 135)
DILMTQSPSSMSVSLGDTVSITCHASQGINNNIGWLQRKPGKSFKGLIYHGTNLEDGVPSRFSGSGSGA

DYSLTISSLESEDFADYYCVQYVQFPRTFGGGTKLEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSEVQLVESGGGLVQPGGSLRLSCAASGFTFTNYGLHWVRQAPG

KGLEWVSSISPSGGVTYYRDSVKGRFTISRDNSKNTLYLQMNSLRAEDTAVYYCAKPFLGWGGANWIAH

WGQGTLVTVSSGGGGSGGGGSGGGGSGGGGSDIQMTQSPSSLSASVGDRVTITCLASEDISNDLAWYQQ

KPGKAPKLLIYFVDRLLDGVPSRFSGSGSGTDFTLTISSLQPEDFATYYCQQSYKYPPTFGQGTKLEIK

Ly482
First polypeptide (from N→C terminus, heavy chain of Ly361 with IgG1 mutated Fc
region and scFv of Ly253 in VL→VH orientation; SEQ ID NO: 136)
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

-continued

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGSGGGGSGGGGSGGGGSDIQMTQSPSSVSASVG

DRVTITCRASQGIYSWLAWYQQKPGKAPNLLIYTASTLQSGVPSRFSGSGSGTDFTLTISSLQPEDFAT

YYCQQANIFPLTFGGGTKVEIKGGGGSGGGGSGGGGSGGGGSQVQLVQSGAEVKKPGASVKVSCKASGY

TFTGYYMHWVRQAPGQGLEWMGWINPDSGGTNYAQKFQGRVTMTRDTSISTAYMELNRLRSDDTAVYYC

ARDQPLGYCTNGVCSYFDYWGQGTLVTVSS

Second polypeptide: light chain of Ly361 (SEQ ID NO: 124)

Ly483
First polypeptide (from N→C terminus, heavy chain of Ly361 with IgG1 mutated Fc
region and scFv of Ly253 in VH→VL orientation; SEQ ID NO: 137)
EVQLVESGGDLVKPGGSLKLSCAASGFTFSSYGMSWVRQTPDKRLEWVAAISTGGSYTYYPDSVKGRFT

ISRDTATNTLYLQMSTLKSEDTAMYYCTRRGATGSWFAYWGQGTLVTVSAASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGSGGGGSGGGGSGGGGSQVQLVQSGAEVKKPGA

SVKVSCKASGYTFTGYYMHWVRQAPGQGLEWMGWINPDSGGTNYAQKFQGRVTMTRDTSISTAYMELNR

LRSDDTAVYYCARDQPLGYCTNGVCSYFDYWGQGTLVTVSSGGGGSGGGGSGGGGSGGGGSDIQMTQSP

SSVSASVGDRVTITCRASQGIYSWLAWYQQKPGKAPNLLIYTASTLQSGVPSRFSGSGSGTDFTLTISS

LQPEDFATYYCQQANIFPLTFGGGTKVEIK

Second polypeptide: light chain of Ly361 (SEQ ID NO: 124)

Ly484
First polypeptide: heavy chain of Ly476 (SEQ ID NO: 129)

Second polypeptide (from N→C terminus, light chain of Ly361 and scFv of Ly253 in
VL→VH orientation; SEQ ID NO: 138)
DILMTQSPSSMSVSLGDTVSITCHASQGINNNIGWLQRKPGKSFKGLIYHGTNLEDGVPSRFSGSGSGA

DYSLTISSLESEDFADYYCVQYVQFPRTFGGGTKLEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSVSASVGDRVTITCRASQGIYSWLAWYQQKPGK

APNLLIYTASTLQSGVPSRFSGSGSGTDFTLTISSLQPEDFATYYCQQANIFPLTFGGGTKVEIKGGGG

SGGGGSGGGGSGGGGSQVQLVQSGAEVKKPGASVKVSCKASGYTFTGYYMHWVRQAPGQGLEWMGWINP

DSGGTNYAQKFQGRVTMTRDTSISTAYMELNRLRSDDTAVYYCARDQPLGYCTNGVCSYFDYWGQGTLV

TVSS

Ly485
First polypeptide: heavy chain of Ly476 (SEQ ID NO: 129)

Second polypeptide (from N→C terminus, light chain of Ly361 and scFv of Ly253 in
VH→VL orientation; SEQ ID NO: 139)
DILMTQSPSSMSVSLGDTVSITCHASQGINNNIGWLQRKPGKSFKGLIYHGTNLEDGVPSRFSGSGSGA

DYSLTISSLESEDFADYYCVQYVQFPRTFGGGTKLEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSQVQLVQSGAEVKKPGASVKVSCKASGYTFTGYYMHWVRQAPG

QGLEWMGWINPDSGGTNYAQKFQGRVTMTRDTSISTAYMELNRLRSDDTAVYYCARDQPLGYCTNGVCS

YFDYWGQGTLVTVSSGGGGSGGGGSGGGGSGGGGSDIQMTQSPSSVSASVGDRVTITCRASQGIYSWLA

WYQQKPGKAPNLLIYTASTLQSGVPSRFSGSGSGTDFTLTISSLQPEDFATYYCQQANIFPLTFGGGTK

VEIK

Ly486
First polypeptide (from N→C terminus, heavy chain of Ly366 with IgG1 mutated Fc
region and scFv of TM740 in VL→VH orientation; SEQ ID NO: 140)
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGGSGGGGSGGGGSGGGGSDIQMTQSPSSLSASVGDR

VTITCKASQNIYIYLNWYQQKPGKAPKLLIYNTNNLQTGVPSRFSGSGSGTDFTLTISSLQPEDFATYY

CLQHSSRRTFGGGTKVEIKGGGGSGGGGSGGGGSGGGGSQVQLVESGGGLVQPGGSLKLSCATSGFNFN

DYFMNWVRQASGKGLEWVGQIRNKNYNYATYYTESLEGRVTISRDDSKNTAYLQMNSLKTEDTAVYYCT

SYYYDGFADYFDYWGQGTTVTVSS

Second polypeptide: light chain of Ly366 (SEQ ID NO: 126)

Ly487
First polypeptide (from N→C terminus, heavy chain of Ly366 with IgG1 mutated Fc
region and scFv of TM740 in VH→VL orientation; SEQ ID NO: 141)
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGGSGGGGSGGGGSGGGGSQVQLVESGGGLVQPGGSL

KLSCATSGFNFNDYFMNWVRQASGKGLEWVGQIRNKNYNYATYYTESLEGRVTISRDDSKNTAYLQMNS

LKTEDTAVYYCTSYYYDGFADYFDYWGQGTTVTVSSGGGGSGGGGSGGGGSGGGGSDIQMTQSPSSLSA

SVGDRVTITCKASQNIYIYLNWYQQKPGKAPKLLIYNTNNLQTGVPSRFSGSGSGTDFTLTISSLQPED

FATYYCLQHSSRRTFGGGTKVEIK

Second polypeptide: light chain of Ly366 (SEQ ID NO: 126)

Ly488
First polypeptide: heavy chain of Ly366 with IgG1 mutated Fc (SEQ ID NO: 142):
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGK

Second polypeptide (from N→C terminus, light chain of Ly366 and scFv of TM740 in
VL→VH orientation; SEQ ID NO: 143)
EIVLTQSPTTMAASPGEKITIFCSASSSISSDFLHWYQQKPGFSPKLLIYRISNLASGVPARFSGSGSG

TSYSLTIGTMEAEDVATYYCQQGSNVPRTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSLSASVGDRVTITCKASQNIYIYLNWYQQKPG

KAPKLLIYNTNNLQTGVPSRFSGSGSGTDFTLTISSLQPEDFATYYCLQHSSRRTFGGGTKVEIKGGGG

SGGGGSGGGGSGGGGSQVQLVESGGGLVQPGGSLKLSCATSGFNFNDYFMNWVRQASGKGLEWVGQIRN

KNYNYATYYTESLEGRVTISRDDSKNTAYLQMNSLKTEDTAVYYCTSYYYDGFADYFDYWGQGTTVTVS

S

Ly489
First polypeptide: heavy chain of Ly488 (SEQ ID NO: 142)

Second polypeptide (from N→C terminus, light chain of Ly366 and scFv of TM740 in
VH→VL orientation; SEQ ID NO: 144)
EIVLTQSPTTMAASPGEKITIFCSASSSISSDFLHWYQQKPGFSPKLLIYRISNLASGVPARFSGSGSG

TSYSLTIGTMEAEDVATYYCQQGSNVPRTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGsQVQLVESGGGLVQPGGSLKLSCATSGFNFNDYFMNWVRQAS

GKGLEWVGQIRNKNYNYATYYTESLEGRVTISRDDSKNTAYLQMNSLKTEDTAVYYCTSYYYDGFADYF

DYWGQGTTVTVSSGGGGSGGGGSGGGGSGGGGSDIQMTQSPSSLSASVGDRVTITCKASQNIYIYLNWY

QQKPGKAPKLLIYNTNNLQTGVPSRFSGSGSGTDFTLTISSLQPEDFATYYCLQHSSRRTFGGGTKVEI

K

Ly490
First polypeptide (from N→C terminus, heavy chain of Ly366 with IgG1 mutated Fc
region and scFv of TM559 in VL→VH orientation; SEQ ID NO: 145)
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGGSGGGGSGGGGSGGGGSDIQMTQSPSSLSASVGDR

VTITCLASEDISNDLAWYQQKPGKAPKLLIYFVDRLLDGVPSRFSGSGSGTDFTLTISSLQPEDFATYY

CQQSYKYPPTFGQGTKLEIKGGGGSGGGGSGGGGSGGGGSEVQLVESGGGLVQPGGSLRLSCAASGFTF

TNYGLHWVRQAPGKGLEWVSSISPSGGVTYYRDSVKGRFTISRDNSKNTLYLQMNSLRAEDTAVYYCAK

PFLGWGGANWIAHWGQGTLVTVSS

Second polypeptide: light chain of Ly366 (SEQ ID NO: 126)

Ly491
First polypeptide (from N→C terminus, heavy chain of Ly366 with IgG1 mutated Fc
region and scFv of TM559 in VH→VL orientation; SEQ ID NO: 146)
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGGSGGGGSGGGGSGGGGSEVQLVESGGGLVQPGGSL

RLSCAASGFTFTNYGLHWVRQAPGKGLEWVSSISPSGGVTYYRDSVKGRFTISRDNSKNTLYLQMNSLR

AEDTAVYYCAKPFLGWGGANWIAHWGQGTLVTVSSGGGGSGGGGSGGGGSGGGGSDIQMTQSPSSLSAS

-continued

VGDRVTITCLASEDISNDLAWYQQKPGKAPKLLIYFVDRLLDGVPSRFSGSGSGTDFTLTISSLQPEDF

ATYYCQQSYKYPPTFGQGTKLEIK

Second polypeptide: light chain of Ly366 (SEQ ID NO: 126)

Ly492
First polypeptide: heavy chain of Ly488 (SEQ ID NO: 142)

Second polypeptide (from N→C terminus, light chain of Ly366 and scFv of TM559 in
VL→VH orientation; SEQ ID NO: 147)
EIVLTQSPTTMAASPGEKITIFCSASSSISSDFLHWYQQKPGFSPKLLIYRISNLASGVPARFSGSGSG

TSYSLTIGTMEAEDVATYYCQQGSNVPRTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSLSASVGDRVTITCLASEDISNDLAWYQQKPG

KAPKLLIYFVDRLLDGVPSRFSGSGSGTDFTLTISSLQPEDFATYYCQQSYKYPPTFGQGTKLEIKGGG

GSGGGGSGGGGSGGGGSEVQLVESGGGLVQPGGSLRLSCAASGFTFTNYGLHWVRQAPGKGLEWVSSIS

PSGGVTYYRDSVKGRFTISRDNSKNTLYLQMNSLRAEDTAVYYCAKPFLGWGGANWIAHWGQGTLVTVS

S

Ly493
First polypeptide: heavy chain of Ly488 (SEQ ID NO: 142)

Second polypeptide (from N→C terminus, light chain of Ly366 and scFv of TM559 in
VH→VL orientation; SEQ ID NO: 148)
EIVLTQSPTTMAASPGEKITIFCSASSSISSDFLHWYQQKPGFSPKLLIYRISNLASGVPARFSGSGSG

TSYSLTIGTMEAEDVATYYCQQGSNVPRTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSEVQLVESGGGLVQPGGSLRLSCAASGFTFTNYGLHWVRQAP

GKGLEWVSSISPSGGVTYYRDSVKGRFTISRDNSKNTLYLQMNSLRAEDTAVYYCAKPFLGWGGANWIA

HWGQGTLVTVSSGGGGSGGGGSGGGGSGGGGSDIQMTQSPSSLSASVGDRVTITCLASEDISNDLAWYQ

QKPGKAPKLLIYFVDRLLDGVPSRFSGSGSGTDFTLTISSLQPEDFATYYCQQSYKYPPTFGQGTKLEI

K

Ly494
First polypeptide (from N→C terminus, heavy chain of Ly366 with IgG1 mutated Fc
region and scFv of Ly253 in VL→VH orientation; SEQ ID NO: 149)
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGGSGGGGSGGGGSGGGGSDIQMTQSPSSVSASVGDR

VTITCRASQGIYSWLAWYQQKPGKAPNLLIYTASTLQSGVPSRFSGSGSGTDFTLTISSLQPEDFATYY

CQQANIFPLTFGGGTKVEIKGGGGSGGGGSGGGGSGGGGSQVQLVQSGAEVKKPGASVKVSCKASGYTF

TGYYMHWVRQAPGQGLEWMGWINPDSGGTNYAQKFQGRVTMTRDTSISTAYMELNRLRSDDTAVYYCAR

DQPLGYCTNGVCSYFDYWGQGTLVTVSS

-continued

Second polypeptide: light chain of Ly366 (SEQ ID NO: 126)

Ly495
First polypeptide (from N→C terminus, heavy chain of Ly366 with IgG1 mutated Fc
region and scFv of Ly253 in VH→VL orientation; SEQ ID NO: 150)
EVQLVESGGGLVKPGGSLKLSCAASGFTFSDSGMHWVRQAPEKGLEWITYINSGSSTIYYADSVKGRFT

ISRDNAKNTLFLQMTSLRSEDTAMYYCARGRGYAMDYWGQGTSVTVSSASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGGSGGGGSGGGGSGGGGSQVQLVQSGAEVKKPGASV

KVSCKASGYTFTGYYMHWVRQAPGQGLEWMGWINPDSGGTNYAQKFQGRVTMTRDTSISTAYMELNRLR

SDDTAVYYCARDQPLGYCTNGVCSYFDYWGQGTLVTVSSGGGGSGGGGSGGGGSGGGGSDIQMTQSPSS

VSASVGDRVTITCRASQGIYSWLAWYQQKPGKAPNLLIYTASTLQSGVPSRFSGSGSGTDFTLTISSLQ

PEDFATYYCQQANIFPLTFGGGTKVEIK

Second polypeptide: light chain of Ly366 (SEQ ID NO: 126)

Ly496
First polypeptide: heavy chain of Ly488 (SEQ ID NO: 142)

Second polypeptide (from N→C terminus, light chain of Ly366 and scFv of Ly253 in
VL→VH orientation; SEQ ID NO: 151)
EIVLTQSPTTMAASPGEKITIFCSASSSISSDFLHWYQQKPGFSPKLLIYRISNLASGVPARFSGSGSG

TSYSLTIGTMEAEDVATYYCQQGSNVPRTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSVSASVGDRVTITCRASQGIYSWLAWYQQKPG

KAPNLLIYTASTLQSGVPSRFSGSGSGTDFTLTISSLQPEDFATYYCQQANIFPLTFGGGTKVEIKGGG

GSGGGGSGGGGSGGGGSQVQLVQSGAEVKKPGASVKVSCKASGYTFTGYYMHWVRQAPGQGLEWMGWIN

PDSGGTNYAQKFQGRVTMTRDTSISTAYMELNRLRSDDTAVYYCARDQPLGYCTNGVCSYFDYWGQGTL

VTVSS

Ly497
First polypeptide: heavy chain of Ly488 (SEQ ID NO: 142)

Second polypeptide (from N→C terminus, light chain of Ly366 and scFv of Ly253 in
VH→VL orientation; SEQ ID NO: 152)
EIVLTQSPTTMAASPGEKITIFCSASSSISSDFLHWYQQKPGFSPKLLIYRISNLASGVPARFSGSGSG

TSYSLTIGTMEAEDVATYYCQQGSNVPRTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSQVQLVQSGAEVKKPGASVKVSCKASGYTFTGYYMHWVRQAP

GQGLEWMGWINPDSGGTNYAQKFQGRVTMTRDTSISTAYMELNRLRSDDTAVYYCARDQPLGYCTNGVC

SYFDYWGQGTLVTVSSGGGGSGGGGSGGGGSGGGGSDIQMTQSPSSVSASVGDRVTITCRASQGIYSWL

AWYQQKPGKAPNLLIYTASTLQSGVPSRFSGSGSGTDFTLTISSLQPEDFATYYCQQANIFPLTFGGGT

KVEIK

Characterization of Anti-B7H4/CD40 Bi-Specific Antibodies (i) Binding Activity

Anti-B7H4/CD40 bi-specific antibodies were analyzed by FACS for their binding properties to human B7H4 or human CD40 expressed on CHO cells. Briefly, cultured cells were harvested, counted and cell viability was evaluated using the Trypan Blue exclusion method. Viable cells were then adjusted to $2\times10^6$ cells per mL in PBS containing 2% BSA. 100 μL of this cell suspension were further aliquoted per well into a V-bottom 96-well plate. 50 μL of the bi-specific antibodies or corresponding IgG control were added to the cell-containing wells to obtain final concentrations of 0.1 μg/mL to 10 μg/mL. After incubation for 2 hours at 4° C., cells were centrifuged (3 min, 1000×g), washed with 250 µL/well BSA-containing FACS Stain Buffer, resuspended and incubated for an additional 1 hour at 4° C. with 100 µL/well fluorochrome-conjugated anti-IgG antibody for detection of the bispecific antibody. Cells were then washed with 250 µL/well BSA-containing FACS Stain Buffer, resuspended in 100 µL/well FACS Stain Buffer, acquired and analyzed using a FACS machine. Binding of the bispecific antibodies to human B7H4 or human CD40 expressing CHO cells were evaluated and the mean fluorescence intensity is plotted in histograms or dot plots.

As shown in FIGS. 19A-19D, the exemplary anti-B7H4/CD40 bi-specific antibodies exhibited similar binding affinity to human B7H4 expressed on CHO cells as parent antibodies Ly361 and Ly366. As shown in FIGS. 20A-20D, these antibodies exhibited binding affinity to human CD40 expressed on CHO cells as well. Compared to the corresponding parental antibody, the binding activity of the bi-specific antibodies comprising scFv formats of the CD40 antibodies remain minimally changed.

Anti-B7H4/CD40 bi-specific antibodies were analyzed by ELISA for their simultaneous binding to recombinant human B7H4 and human CD40. Briefly, human B7H4 protein was diluted and coated onto an ELISA plate with a volume of 100/well by incubation at 4° C. overnight. The next day, the plate was blocked by PBST-BSA buffer, then serially diluted samples of anti-B7H4/CD40 bi-specific antibodies were pipetted into appropriate wells at 50 µL/well, and the plate was incubated for 1 h followed by Washing. Human CD40 ECD protein (mouse IgG2a Fc tag) was added into the plate at 50 µL/well. After 1-hour incubation at room temperature, HRP-conjugated anti-mouse IgG (H+L) antibody was added into the plate at 100 µL/well. The plate was incubated for 1 hour at room temperature followed by washing. TMB substrate solution was added at 100 µL/well and the color development was stopped by adding 100 µL/well Stop Solution (2N $H_2SO_4$). Absorbance at 450 nm and 620 nm was read by Tecan F200 Pro plate reader. GraphPad 7.0, "[Agonist] vs. response—Variable slope (four parameters)" was used to plot the binding data and calculate binding EC50 values.

As shown in FIGS. 21A-21I, the exemplary anti-B7H4/CD40 bi-specific antibodies simultaneously binded to crecombinant human B7H4 and human recombinant CD40.

(ii) Agonistic Activity for CD40

The CD40 reporter assay disclosed herein was used to determine the agonist activity of the bispecific antibodies, following the same procedures disclosed in Example 2 above. The CD40 reporter assay was also performed in co-culture with B7H4-expressing CHO cells.

As shown in FIGS. 22A-22L, the bispecific antibodies showed a range of agonist activities when tested in solution. Co-culture with B7H4 expressing cells enhanced CD40 agonist activity in majority of the bispecific antibodies. Binding to CD40 and B7H4 by the tested antibody molecules simultaneously in a microenvironment would affect individual binding due to the avidity effect, which refers to the accumulated strength of multiple affinities of individual non-covalent binding interactions. The antibodies showed increased activity when co-cultured with B7-H4-expressing CHO cells. Therefore, binding profile to human B7H4 and CD40 would affect the agonist activity of these bispecific antibodies.

(iii) B Cell Proliferation

Anti-B7H4/CD40 bispecific antibodies were evaluated for the activity to stimulate the proliferation of human B cells following the procedures disclosed in Example 3 above. As shown in FIGS. 23A-23D, these bispecific antibodies exhibited distinct effect on the proliferation of B cells with most of them showed minimal activity in stimulating B cell proliferation.

(iv) Dendritic Cell Activation

The anti-B7H4/CD40 antibodies were tested in vitro for CD40 binding activities and agonistic activity as described in Examples above. Their activities in activating human dendritic cells were carried out as described in Example 3 above. The DC activation assay was also performed in co-culture with B7H4 expressing CHO cells.

As shown FIGS. 24A-24H, the tested exemplary anti-B7H4/CD40 antibodies stimulated DC activation at various degrees as evidenced by the secretion of IL8 from the DC culture after antibody incubation. The magnitude of DC activation was increased, likely due to binding of CD40 and B7H4 by the bispecific antibody molecules simultaneously in a microenvironment, which would affect individual binding due to avidity effect leading to alteration of CD40 agonistic effect of the antibodies.

(v) Pharmacokinetic Studies of Anti-B7H4/CD40 Bi-Specific Antibodies

C57BL/6 mice (6-7 weeks old, 19-20 g, female, purchased from SLAC Laboratory Animal Co. LTD) were used for the study. Antibodies were formulated in PBS and administered via tail vein injection at 5 mg/kg in a group of 4 mice.

Blood sampling was done at pre-dose, 1d, 4d, 7d, 10d, 14d, 17d and 21d by serial bleeding. 10 µL blood per time point was added to 40 µL of a PBS-BSA solution. The sample was then mixed well and centrifuged at 2000 g for 5 minutes at 4° C. The supernatant was put on dry ice immediately after collection and stored at approximately –70° C. until analysis. Blood antibody concentrations were determined by ELISA. FIGS. 25A-25I showed the blood concentrations of the bispecific antibodies after a single intravenous injection of 3 mg/kg. These bispecific antibodies showed high and lasting circulation concentrations.

Example 5: Anti-CEA/CD40 Bi-Specific Antibodies

Anti-CEA/CD40 bi-specific antibodies are produced for the human or humanized anti-CD40 antibodies exemplified above. cDNAs encoding the VH and VL chains of anti-CEA antibodies and the VH and VL chains of anti-CD40 antibodies are used as the starting materials. CHO-cell transient expression was carried out using plasmids configured for expressing the chains of the bi-specific antibodies. These antibodies were purified by protein A affinity chromatography.

The amino acid sequences of the heavy chain (HC) and the light chain (LC) of the anti-CEA antibodies (Ly311 and Ly312) and the amino acid sequences of the polypeptide components of the bi-specific antibodies are provided below:

Ly311
Heavy chain (SEQ ID NO: 153):
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGK

Light chain (SEQ ID NO: 154)
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGEC

Ly312
Heavy chain (SEQ ID NO: 155):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGK

Light chain (SEQ ID NO: 156):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGEC

Ly401
First polypeptide (from N→C terminus, heavy chain of Ly311 with IgG1 mutated Fc
region and scFv of TM740 in VL→VH orientation; SEQ ID NO: 157)
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSLSASVG

DRVTITCKASQNIYIYLNWYQQKPGKAPKLLIYNTNNLQTGVPSRFSGSGSGTDFTLTISSLQPEDFAT

YYCLQHSSRRTFGGGTKVEIKGGGGSGGGGSGGGGSGGGGSQVQLVESGGGLVQPGGSLKLSCATSGFN

FNDYFMNWVRQASGKGLEWVGQIRNKNYNYATYYTESLEGRVTISRDDSKNTAYLQMNSLKTEDTAVYY

CTSYYYDGFADYFDYWGQGTTVTVSS

Second polypeptide: light chain of Ly311 (SEQ ID NO: 154)

Ly402
First polypeptide (from N→C terminus, heavy chain of Ly311 with IgG1 mutated Fc
region and scFv of TM740 in VH→VL orientation; SEQ ID NO: 158)
EVQLVESGGGVVQPGRSLRLSCSASGFDFTTYWMSWVRQAPGKGLEWIGEIHPDSSTINYAPSLKDRF

TISRDNAKNTLFLQMDSLRPEDTGVYFCASLYFGFPWFAYWGQGTPVTVSSASTKGPSVFPLAPSSKS

TSGGTAALGCLVKDYFPEPVTVSWNSGALTSGVHTFPAVLQSSGLYSLSSVVTVPSSSLGTQTYICNV

NHKPSNTKVDKKVEPKSCDKTHTCPPCPAPELLGPSVFLFPPKPKDTLMISRTPEVTCVVVDVSHEDP

EVKFNWYVDGVEVHNAKTKPREEQYNSTYRVVSVLTVLHQDWLNGKEYKCKVSNKALPAPIEKTISKA

KGQPREPQVYTLPPSREEMTKNQVSLTCLVKGFYPSDIAVEWESNGQPENNYKTTPPVLDSDGSFFLY

SKLTVDKSRWQQGNVFSCSVMHEALHNHYTQKSLSLSPGGGGSGSGGGGSGGGGSGGGGSQVQLVESGG

GLVQPGGSLKLSCATSGFNFNDYFMNWVRQASGKGLEWVGQIRNKNYNYATYYTESLEGRVTISRDDS

KNTAYLQMNSLKTEDTAVYYCTSYYYDGFADYFDYWGQGTTVTVSSGGGGSGGGGSGGGGSGGGGSDI

QMTQSPSSLSASVGDRVTITCKASQNIYIYLNWYQQKPGKAPKLLIYNTNNLQTGVPSRFSGSGSGTD

FTLTISSLQPEDFATYYCLQHSSRRTFGGGTKVEIK

Second polypeptide: light chain of Ly311 (SEQ ID NO: 154)

Ly403
First polypeptide: heavy chain of Ly311 with IgG1 mutated Fc (SEQ ID NO: 159):
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGK

Second polypeptide (from N→C terminus, light chain of Ly311 and scFv of TM740
in VL→VH orientation; (SEQ ID NO: 160)
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCKASQNIYIYLNWYQQKPGKA

PKLLIYNTNNLQTGVPSRFSGSGSGTDFTLTISSLQPEDFATYYCLQHSSRRTFGGGTKVEIKGGGGSG

GGGSGGGGSGGGGSQVQLVESGGGLVQPGGSLKLSCATSGFNFNDYFMNWVRQASGKGLEWVGQIRNKN

YNYATYYTESLEGRVTISRDDSKNTAYLQMNSLKTEDTAVYYCTSYYYDGFADYFDYWGQGTTVTVSS

Ly404
First polypeptide: heavy chain of Ly403 (SEQ ID NO: 159)

Second polypeptide (from N→C terminus, light chain of Ly311 and scFv of TM740 in
VH→VL orientation; SEQ ID NO: 161)
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVESGGGLVQPGGSLKLSCATSGFNFNDYFMNWVRQASGK

GLEWVGQIRNKNYNYATYYTESLEGRVTISRDDSKNTAYLQMNSLKTEDTAVYYCTSYYYDGFADYFDY

WGQGTTVTVSSGGGGSGGGGSGGGGSGGGGSDIQMTQSPSSLSASVGDRVTITCKASQNIYIYLNWYQQ

KPGKAPKLLIYNTNNLQTGVPSRFSGSGSGTDFTLTISSLQPEDFATYYCLQHSSRRTFGGGTKVEIK

-continued

Ly405
First polypeptide (from N→C terminus, heavy chain of Ly312 with IgG1 mutated Fc
region and scFv of TM740 in VL→VH orientation; SEQ ID NO: 162)
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSDIQMTQSPSSLSAS

VGDRVTITCKASQNIYIYLNWYQQKPGKAPKLLIYNTNNLQTGVPSRFSGSGSGTDFTLTISSLQPEDF

ATYYCLQHSSRRTFGGGTKVEIKGGGGSGGGGSGGGGSGGGGSQVQLVESGGGLVQPGGSLKLSCATSG

FNFNDYFMNWVRQASGKGLEWVGQIRNKNYNYATYYTESLEGRVTISRDDSKNTAYLQMNSLKTEDTAV

YYCTSYYYDGFADYFDYWGQGTTVTVSS

Second polypeptide: light chain of Ly312 (SEQ ID NO: 156)

Ly406
First polypeptide (from N→C terminus, heavy chain of Ly312 with IgG1 mutated Fc
region and scFv of TM740 in VH→VL orientation; SEQ ID NO: 163):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSQVQLVESGGGLVQP

GGSLKLSCATSGFNFNDYFMNWVRQASGKGLEWVGQIRNKNYNYATYYTESLEGRVTISRDDSKNTAYL

QMNSLKTEDTAVYYCTSYYYDGFADYFDYWGQGTTVTVSSGGGGSGGGGSGGGGSGGGGSDIQMTQSPS

SLSASVGDRVTITCKASQNIYIYLNWYQQKPGKAPKLLIYNTNNLQTGVPSRFSGSGSGTDFTLTISSL

QPEDFATYYCLQHSSRRTFGGGTKVEIK

Second polypeptide: light chain of Ly312 (SEQ ID NO: 156)

Ly407
First polypeptide: heavy chain of Ly312 with IgG1 mutated Fc (SEQ ID NO: 164):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

Second polypeptide (from N→C terminus, light chain of Ly312 and scFv of TM740 in
VL→VH orientation; SEQ ID NO: 165):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGECGGGGSGGGGSGGGGSGGGGSDIQMTQSPSSLSASVGDRVTITCKASQNIYIYLNWYQQ

KPGKAPKLLIYNTNNLQTGVPSRFSGSGSGTDFTLTISSLQPEDFATYYCLQHSSRRTFGGGTKVEIKG

GGGSGGGGSGGGGSGGGGSQVQLVESGGGLVQPGGSLKLSCATSGFNFNDYFMNWVRQASGKGLEWVGQ

IRNKNYNYATYYTESLEGRVTISRDDSKNTAYLQMNSLKTEDTAVYYCTSYYYDGFADYFDYWGQGTTV

TVSS

Ly408
First polypeptide: heavy chain of Ly407 (SEQ ID NO: 164)

Second polypeptide (from N→C terminus, light chain of Ly312 and scFv of TM740 in
VH→VL orientation; SEQ ID NO: 166):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGECGGGGSGGGGSGGGGSGGGGSQVQLVESGGGLVQPGGSLKLSCATSGFNFNDYFMNWVR

QASGKGLEWVGQIRNKNYNYATYYTESLEGRVTISRDDSKNTAYLQMNSLKTEDTAVYYCTSYYYDGFA

DYFDYWGQGTTVTVSSGGGGSGGGGSGGGGSGGGGSDIQMTQSPSSLSASVGDRVTITCKASQNIYIYL

NWYQQKPGKAPKLLIYNTNNLQTGVPSRFSGSGSGTDFTLTISSLQPEDFATYYCLQHSSRRTFGGGTK

VEIK

Ly409
First polypeptide (from N→C terminus, heavy chain of Ly311 with IgG1 mutated Fc
region and scFv of TM559 in VL→VH orientation; SEQ ID NO: 167):
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSLSASVG

DRVTITCLASEDISNDLAWYQQKPGKAPKLLIYFVDRLLDGVPSRFSGSGSGTDFTLTISSLQPEDFAT

YYCQQSYKYPPTFGQGTKLEIKGGGGSGGGGSGGGGSGGGGSEVQLVESGGGLVQPGGSLRLSCAASGF

TFTNYGLHWVRQAPGKGLEWVSSISPSGGVTYYRDSVKGRFTISRDNSKNTLYLQMNSLRAEDTAVYYC

AKPFLGWGGANWIAHWGQGTLVTVSS

Second polypeptide: light chain of Ly311 (SEQ ID NO: 154)

Ly410
First polypeptide (from N→C terminus, heavy chain of Ly311 with IgG1 mutated Fc
region and scFv of TM559 in VH→VL orientation; SEQ ID NO: 168):
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSEVQLVESGGGLVQPGG

SLRLSCAASGFTFTNYGLHWVRQAPGKGLEWVSSISPSGGVTYYRDSVKGRFTISRDNSKNTLYLQMNS

LRAEDTAVYYCAKPFLGWGGANWIAHWGQGTLVTVSSGGGGSGGGGSGGGGSGGGGSDIQMTQSPSSLS

ASVGDRVTITCLASEDISNDLAWYQQKPGKAPKLLIYFVDRLLDGVPSRFSGSGSGTDFTLTISSLQPE

DFATYYCQQSYKYPPTFGQGTKLEIK

Second polypeptide: light chain of Ly311 (SEQ ID NO: 154)

Ly411
First polypeptide: heavy chain of Ly403 (SEQ ID NO: 159)

Second polypeptide (from N→C terminus, light chain of Ly311 and scFv of TM559 in
VL→VH orientation; SEQ ID NO: 169):
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCLASEDISNDLAWYQQKPGKA

PKLLIYFVDRLLDGVPSRFSGSGSGTDFTLTISSLQPEDFATYYCQQSYKYPPTFGQGTKLEIKGGGGS

GGGGSGGGGSGGGGSEVQLVESGGGLVQPGGSLRLSCAASGFTFTNYGLHWVRQAPGKGLEWVSSISPS

GGVTYYRDSVKGRFTISRDNSKNTLYLQMNSLRAEDTAVYYCAKPFLGWGGANWIAHWGQGTLVTVSS

Ly412
First polypeptide: heavy chain of Ly403 (SEQ ID NO: 159)

Second polypeptide (from N→C terminus, light chain of Ly311 and scFv of TM559 in
VH→VL orientation; SEQ ID NO: 170):
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSEVQLVESGGGLVQPGGSLRLSCAASGFTFTNYGLHWVRQAPGK

GLEWVSSISPSGGVTYYRDSVKGRFTISRDNSKNTLYLQMNSLRAEDTAVYYCAKPFLGWGGANWIAHW

GQGTLVTVSSGGGGSGGGGSGGGGSGGGGSDIQMTQSPSSLSASVGDRVTITCLASEDISNDLAWYQQK

PGKAPKLLIYFVDRLLDGVPSRFSGSGSGTDFTLTISSLQPEDFATYYCQQSYKYPPTFGQGTKLEIK

Ly413
First polypeptide (from N→C terminus, heavy chain of Ly312 with IgG1 mutated Fc
region and scFv of TM559 in VL→VH orientation; SEQ ID NO: 171):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSDIQMTQSPSSLSAS

VGDRVTITCLASEDISNDLAWYQQKPGKAPKLLIYFVDRLLDGVPSRFSGSGSGTDFTLTISSLQPEDF

ATYYCQQSYKYPPTFGQGTKLEIKGGGGSGGGGSGGGGSGGGGSEVQLVESGGGLVQPGGSLRLSCAAS

GFTFTNYGLHWVRQAPGKGLEWVSSISPSGGVTYYRDSVKGRFTISRDNSKNTLYLQMNSLRAEDTAVY

YCAKPFLGWGGANWIAHWGQGTLVTVSS

Second polypeptide: light chain of Ly312 (SEQ ID NO: 156)

Ly414
First polypeptide (from N→C terminus, heavy chain of Ly312 with IgG1 mutated Fc
region and scFv of TM559 in VH→VL orientation; SEQ ID NO: 172):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSEVQLVESGGGLVQP

GGSLRLSCAASGFTFTNYGLHWVRQAPGKGLEWVSSISPSGGVTYYRDSVKGRFTISRDNSKNTLYLQM

NSLRAEDTAVYYCAKPFLGWGGANWIAHWGQGTLVTVSSGGGGSGGGGSGGGGSGGGGSDIQMTQSPSS

LSASVGDRVTITCLASEDISNDLAWYQQKPGKAPKLLIYFVDRLLDGVPSRFSGSGSGTDFTLTISSLQ

PEDFATYYCQQSYKYPPTFGQGTKLEIK

Second polypeptide: light chain of Ly312 (SEQ ID NO: 156)

Ly415
First polypeptide: heavy chain of Ly407 (SEQ ID NO: 164)

Second polypeptide (from N→C terminus, light chain of Ly312 and scFv of TM559 in
VL→VH orientation; SEQ ID NO: 173):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGECGGGGSGGGGSGGGGSGGGGSDIQMTQSPSSLSASVGDRVTITCLASEDISNDLAWYQQ

KPGKAPKLLIYFVDRLLDGVPSRFSGSGSGTDFTLTISSLQPEDFATYYCQQSYKYPPTFGQGTKLEIK

GGGGSGGGGSGGGGSGGGGSEVQLVESGGGLVQPGGSLRLSCAASGFTFTNYGLHWVRQAPGKGLEWVS

SISPSGGVTYYRDSVKGRFTISRDNSKNTLYLQMNSLRAEDTAVYYCAKPFLGWGGANWIAHWGQGTLV

TVSS

Ly416
First polypeptide: heavy chain of Ly407 (SEQ ID NO: 164)

Second polypeptide (from N→C terminus, light chain of Ly312 and scFv of TM559 in
VH→VL orientation; SEQ ID NO: 174):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGECGGGGSGGGGSGGGGSGGGGSEVQLVESGGGLVQPGGSLRLSCAASGFTFTNYGLHWVR

QAPGKGLEWVSSISPSGGVTYYRDSVKGRFTISRDNSKNTLYLQMNSLRAEDTAVYYCAKPFLGWGGAN

WIAHWGQGTLVTVSSGGGGSGGGGSGGGGSGGGGSDIQMTQSPSSLSASVGDRVTITCLASEDISNDLA

WYQQKPGKAPKLLIYFVDRLLDGVPSRFSGSGSGTDFTLTISSLQPEDFATYYCQQSYKYPPTFGQGTK

LEIK

Ly417
First polypeptide (from N→C terminus, heavy chain of Ly311 with IgG1 mutated Fc
region and scFv of Ly253 in VL→VH orientation; SEQ ID NO: 175):
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSVSASVG

DRVTITCRASQGIYSWLAWYQQKPGKAPNLLIYTASTLQSGVPSRFSGSGSGTDFTLTISSLQPEDFAT

YYCQQANIFPLTFGGGTKVEIKGGGGSGGGGSGGGGSGGGGSQVQLVQSGAEVKKPGASVKVSCKASGY

TFTGYYMHWVRQAPGQGLEWMGWINPDSGGTNYAQKFQGRVTMTRDTSISTAYMELNRLRSDDTAVYYC

ARDQPLGYCTNGVCSYFDYWGQGTLVTVSS

-continued

Second polypeptide: light chain of Ly311 (SEQ ID NO: 154)

Ly418
First polypeptide (from N→C terminus, heavy chain of Ly311 with IgG1 mutated Fc
region and scFv of Ly253 in VH→VL orientation; SEQ ID NO: 176):
EVQLVESGGGVVQPGRSLRLSCSASGFDFTTYWMSWVRQAPGKGLEWIGEIHPDSSTINYAPSLKDRFT

ISRDNAKNTLFLQMDSLRPEDTGVYFCASLYFGFPWFAYWGQGTPVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSQVQLVQSGAEVKKPGA

SVKVSCKASGYTFTGYYMHWVRQAPGQGLEWMGWINPDSGGTNYAQKFQGRVTMTRDTSISTAYMELNR

LRSDDTAVYYCARDQPLGYCTNGVCSYFDYWGQGTLVTVSSGGGGSGGGGSGGGGSGGGGSDIQMTQSP

SSVSASVGDRVTITCRASQGIYSWLAWYQQKPGKAPNLLIYTASTLQSGVPSRFSGSGSGTDFTLTISS

LQPEDFATYYCQQANIFPLTFGGGTKVEIK

Second polypeptide: light chain of Ly311 (SEQ ID NO: 154)

Ly419
First polypeptide: heavy chain of Ly403 (SEQ ID NO: 159)

Second polypeptide (from N→C terminus, light chain of Ly311 and scFv of Ly253 in
VL→VH orientation; SEQ ID NO: 177):
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSVSASVGDRVTITCRASQGIYSWLAWYQQKPGKA

PNLLIYTASTLQSGVPSRFSGSGSGTDFTLTISSLQPEDFATYYCQQANIFPLTFGGGTKVEIKGGGGS

GGGGSGGGGSGGGGSQVQLVQSGAEVKKPGASVKVSCKASGYTFTGYYMHWVRQAPGQGLEWMGWINPD

SGGTNYAQKFQGRVTMTRDTSISTAYMELNRLRSDDTAVYYCARDQPLGYCTNGVCSYFDYWGQGTLVT

VSS

Ly420
First polypeptide: heavy chain of Ly403 (SEQ ID NO: 159)

Second polypeptide (from N→C terminus, light chain of Ly311 and scFv of Ly253 in
VH→VL orientation; SEQ ID NO: 178):
DIQLTQSPSSLSASVGDRVTITCKASQDVGTSVAWYQQKPGKAPKLLIYWTSTRHTGVPSRFSGSGSGT

DFTFTISSLQPEDIATYYCQQYSLYRSFGQGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVQSGAEVKKPGASVKVSCKASGYTFTGYYMHWVRQAPGQ

GLEWMGWINPDSGGTNYAQKFQGRVTMTRDTSISTAYMELNRLRSDDTAVYYCARDQPLGYCTNGVCSY

FDYWGQGTLVTVSSGGGGSGGGGSGGGGSGGGGSDIQMTQSPSSVSASVGDRVTITCRASQGIYSWLAW

YQQKPGKAPNLLIYTASTLQSGVPSRFSGSGSGTDFTLTISSLQPEDFATYYCQQANIFPLTFGGGTKV

EIK

Ly421
First polypeptide (from N→C terminus, heavy chain of Ly312 with IgG1 mutated Fc
region and scFv of Ly253 in VL→VH orientation; SEQ ID NO: 179):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

-continued

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSDIQMTQSPSSVSAS

VGDRVTITCRASQGIYSWLAWYQQKPGKAPNLLIYTASTLQSGVPSRFSGSGSGTDFTLTISSLQPEDF

ATYYCQQANIFPLTFGGGTKVEIKGGGGSGGGGSGGGGSGGGGSQVQLVQSGAEVKKPGASVKVSCKAS

GYTFTGYYMHWVRQAPGQGLEWMGWINPDSGGTNYAQKFQGRVTMTRDTSISTAYMELNRLRSDDTAVY

YCARDQPLGYCTNGVCSYFDYWGQGTLVTVSS

Second polypeptide: light chain of Ly312 (SEQ ID NO: 156)

Ly422
First polypeptide (from N→C terminus, heavy chain of Ly312 with IgG1 mutated Fc
region and scFv of Ly253 in VH→VL orientation; SEQ ID NO: 180):
EVQLVESGGGLVQPGGSLRLSCAASGFNIKDTYMHWVRQAPGKGLEWVARIDPANGNSKYADSVKGRFT

ISADTSKNTAYLQMNSLRAEDTAVYYCAPFGYYVSDYAMAYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSQVQLVQSGAEVKKP

GASVKVSCKASGYTFTGYYMHWVRQAPGQGLEWMGWINPDSGGTNYAQKFQGRVTMTRDTSISTAYMEL

NRLRSDDTAVYYCARDQPLGYCTNGVCSYFDYWGQGTLVTVSSGGGGSGGGGSGGGGSGGGGSDIQMTQ

SPSSVSASVGDRVTITCRASQGIYSWLAWYQQKPGKAPNLLIYTASTLQSGVPSRFSGSGSGTDFTLTI

SSLQPEDFATYYCQQANIFPLTFGGGTKVEIK

Second polypeptide: light chain of Ly312 (SEQ ID NO: 156)

Ly423
First polypeptide: heavy chain of Ly407 (SEQ ID NO: 164)

Second polypeptide (from N→C terminus, light chain of Ly312 and scFv of Ly253 in
VL→VH orientation; SEQ ID NO: 181):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGECGGGGSGGGGSGGGGSGGGGSDIQMTQSPSSVSASVGDRVTITCRASQGIYSWLAWYQQ

KPGKAPNLLIYTASTLQSGVPSRFSGSGSGTDFTLTISSLQPEDFATYYCQQANIFPLTFGGGTKVEIK

GGGGSGGGGSGGGGSGGGGSQVQLVQSGAEVKKPGASVKVSCKASGYTFTGYYMHWVRQAPGQGLEWMG

WINPDSGGTNYAQKFQGRVTMTRDTSISTAYMELNRLRSDDTAVYYCARDQPLGYCTNGVCSYFDYWGQ

GTLVTVSS

Ly424
First polypeptide: heavy chain of Ly407 (SEQ ID NO: 164)

Second polypeptide (from N→C terminus, light chain of Ly312 and scFv of Ly253 in
VH→VL orientation; SEQ ID NO: 182):
DIQLTQSPSSLSASVGDRVTITCRAGESVDIFGVGFLHWYQQKPGKAPKLLIYRASNLESGVPSRFSGS

GSRTDFTLTISSLQPEDFATYYCQQTNEDPYTFGQGTKVEIKRTVAAPSVFIFPPSDEQLKSGTASVVC

LLNNFYPREAKVQWKVDNALQSGNSQESVTEQDSKDSTYSLSSTLTLSKADYEKHKVYACEVTHQGLSS

PVTKSFNRGECGGGGSGGGGSGGGGSGGGGSQVQLVQSGAEVKKPGASVKVSCKASGYTFTGYYMHWVR

QAPGQGLEWMGWINPDSGGTNYAQKFQGRVTMTRDTSISTAYMELNRLRSDDTAVYYCARDQPLGYCTN

GVCSYFDYWGQGTLVTVSSGGGGSGGGGSGGGGSGGGGSDIQMTQSPSSVSASVGDRVTITCRASQGIY

-continued

```
SWLAWYQQKPGKAPNLLIYTASTLQSGVPSRFSGSGSGTDFTLTISSLQPEDFATYYCQQANIFPLTFG

GGTKVEIK
```

Characterization of Anti-CEA/CD40 Bi-Specific Antibodies (i) Binding Activity

Anti-CEA/CD40 bi-specific antibodies were analyzed by FACS for their binding properties to human CEA or human CD40 expressed on CHO cells, following the procedures disclosed in Examples 1-3 above.

As shown in FIGS. 26A-26E, the exemplary anti-CEA/CD40 bi-specific antibodies studies in this example exhibited similar binding affinity to human CEA expressed on the CHO cells as relative to Ly311 and Ly312. As shown in FIGS. 27A-27D, these antibodies exhibited binding affinity to human CD40 expressed on CHO cells. Compared to the corresponding parental antibody, the binding activity of the bi-specific antibodies containing scFv formats of the CD40 antibodies remain minimally changed.

(ii) Agonistic Activity for CD40

The CD40 reporter assay disclosed herein was used to determine the agonist activity of the bispecific antibodies, following the same procedures disclosed in Example 2 above. The CD40 reporter assay was also performed in co-culture with CEA-expressing CHO cells.

As shown in FIGS. 28A-28L, the bispecific antibodies in solution showed a various degree of CD40 agonist activity. The agonist activity was greatly enhanced in the co-culture assay. Binding to CD40 and CEA by the tested antibody molecules simultaneously in a microenvironment would affect individual binding due to the avidity effect, which refers to the accumulated strength of multiple affinities of individual non-covalent binding interactions. The antibodies showed increased activity when co-cultured with CEA-expressing CHO cells. Therefore, binding profile to human CEA and CD40 would affect the agonist activity of these bispecific antibodies.

(iii) B Cell Proliferation

Anti-CEA/CD40 bispecific antibodies were evaluated for the activity to stimulate the proliferation of human B cells, following the procedures disclosed in Example 3 above. As shown in FIGS. 29A-29D, these bispecific antibodies exhibited distinct effect on the proliferation of B cells, with many of them showed no effect on B cell proliferation indicating unpredictive nature of these bi-specific proteins.

Example 6: Anti-TNT/CD40 Bi-Specific Antibodies

Tumor necrosis therapy (TNT) can be achieved by utilizing monoclonal antibodies that recognize antigens exposure specifically by necrotic cells. Anti-TNT/CD40 bi-specific antibodies were produced using the human or humanized anti-CD40 antibodies exemplified above. cDNAs encoding the VH and VL chains of an exemplary anti-TNT antibody (Ly368) and the VH and VL chains of the anti-CD40 antibodies disclosed herein were used as the starting materials. CHO-cell transient expression was carried out with plasmids containing the corresponding heavy and light chain sequences. These antibodies were purified by protein A affinity chromatography.

The amino acid sequences of the heavy chain (HC) and the light chain (LC) of the anti-TNT antibody (Ly368) and exemplary anti-TNT/CD40 bi-specific antibodies are provided below:

```
Ly368
Heavy chain (with IgG1 mutated Fc region; SEQ ID NO: 183):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPG

Light chain (SEQ ID NO: 184):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGEC

Ly462
First polypeptide (from N→C terminus, heavy chain of Ly368 and scFv
of TM740 in VL→VH orientation; SEQ ID NO: 185):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK
```

-continued

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSDIQMTQSPSSLSASV

GDRVTITCKASQNIYIYLNWYQQKPGKAPKLLIYNTNNLQTGVPSRFSGSGSGTDFTLTISSLQPEDFA

TYYCLQHSSRRTFGGGTKVEIKGGGGSGGGGSGGGGSGGGGSQVQLVESGGGLVQPGGSLKLSCATSGF

NFNDYFMNWVRQASGKGLEWVGQIRNKNYNYATYYTESLEGRVTISRDDSKNTAYLQMNSLKTEDTAVY

YCTSYYYDGFADYFDYWGQGTTVTVSS

Second polypeptide: light chain of Ly368 (SEQ ID NO: 184)

Ly463
First polypeptide (from N→C terminus, heavy chain of Ly368 and scFv
of TM740 in VH→VL orientation; SEQ ID NO: 186):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSQVQLVESGGGLVQPG

GSLKLSCATSGFNFNDYFMNWVRQASGKGLEWVGQIRNKNYNYATYYTESLEGRVTISRDDSKNTAYLQ

MNSLKTEDTAVYYCTSYYYDGFADYFDYWGQGTTVTVSSGGGGSGGGGSGGGGSGGGGSDIQMTQSPSS

LSASVGDRVTITCKASQNIYIYLNWYQQKPGKAPKLLIYNTNNLQTGVPSRFSGSGSGTDFTLTISSLQ

PEDFATYYCLQHSSRRTFGGGTKVEIK

Second polypeptide: light chain of Ly368 (SEQ ID NO: 184)

Ly464
First polypeptide heavy chain of Ly368 (SEQ ID NO: 183)
Second polypeptide (from N→C terminus, light chain of Ly368 and scFv
of TM740 in VL→VH orientation; SEQ ID NO: 187):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSLSASVGDRVTITCKASQNIYIYLNWYQQKPG

KAPKLLIYNTNNLQTGVPSRFSGSGSGTDFTLTISSLQPEDFATYYCLQHSSRRTFGGGTKVEIKGGGG

SGGGGSGGGGSGGGGSQVQLVESGGGLVQPGGSLKLSCATSGFNFNDYFMNWVRQASGKGLEWVGQIRN

KNYNYATYYTESLEGRVTISRDDSKNTAYLQMNSLKTEDTAVYYCTSYYYDGFADYFDYWGQGTTVTVS

S

Ly465
First polypeptide: heavy chain of Ly368 (SEQ ID NO: 183)
Second polypeptide (from N→C terminus, light chain of Ly368 and scFv
of TM740 in VH→VL orientation; SEQ ID NO: 188):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSQVQLVESGGGLVQPGGSLKLSCATSGFNFNDYFMNWVRQAS

GKGLEWVGQIRNKNYNYATYYTESLEGRVTISRDDSKNTAYLQMNSLKTEDTAVYYCTSYYYDGFADYF

-continued

DYWGQGTTVTVSSGGGGSGGGGSGGGGSGGGGSDIQMTQSPSSLSASVGDRVTITCKASQNIYIYLNWY

QQKPGKAPKLLIYNTNNLQTGVPSRFSGSGSGTDFTLTISSLQPEDFATYYCLQHSSRRTFGGGTKVEI

K

Ly466
First polypeptide (from N→C terminus, heavy chain of Ly368 and scFv
of TM559 in VL→VH orientation; SEQ ID NO: 189):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGSGGGGSGGGGSGGGGSDIQMTQSPSSLSASV

GDRVTITCLASEDISNDLAWYQQKPGKAPKLLIYFVDRLLDGVPSRFSGSGSGTDFTLTISSLQPEDFA

TYYCQQSYKYPPTFGQGTKLEIKGGGGSGGGGSGGGGSGGGGSEVQLVESGGGLVQPGGSLRLSCAASG

FTFTNYGLHWVRQAPGKGLEWVSSISPSGGVTYYRDSVKGRFTISRDNSKNTLYLQMNSLRAEDTAVYY

CAKPFLGWGGANWIAHWGQGTLVTVSS

Second polypeptide: light chain of Ly368 (SEQ ID NO: 184)

Ly467
First polypeptide (from N→C terminus, heavy chain of Ly368 and scFv
of TM559 in VH→VL orientation; SEQ ID NO: 190):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGSGGGGSGGGGSGGGGSEVQLVESGGGLVQPG

GSLRLSCAASGFTFTNYGLHWVRQAPGKGLEWVSSISPSGGVTYYRDSVKGRFTISRDNSKNTLYLQMN

SLRAEDTAVYYCAKPFLGWGGANWIAHWGQGTLVTVSSGGGGSGGGGSGGGGSGGGGSDIQMTQSPSSL

SASVGDRVTITCLASEDISNDLAWYQQKPGKAPKLLIYFVDRLLDGVPSRFSGSGSGTDFTLTISSLQP

EDFATYYCQQSYKYPPTFGQGTKLEIK

Second polypeptide: light chain of Ly368 (SEQ ID NO: 184)

Ly468
First polypeptide: heavy chain of Ly368 (SEQ ID NO: 183)
Second polypeptide (from N→C terminus, light chain of Ly368 and scFv
of TM559 in VL→VH orientation; SEQ ID NO: 191):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSLSASVGDRVTITCLASEDISNDLAWYQQKPG

KAPKLLIYFVDRLLDGVPSRFSGSGSGTDFTLTISSLQPEDFATYYCQQSYKYPPTFGQGTKLEIKGGG

GSGGGGSGGGGSGGGGSEVQLVESGGGLVQPGGSLRLSCAASGFTFTNYGLHWVRQAPGKGLEWVSSIS

PSGGVTYYRDSVKGRFTISRDNSKNTLYLQMNSLRAEDTAVYYCAKPFLGWGGANWIAHWGQGTLVTVS

S

-continued

Ly469
First polypeptide: heavy chain of Ly368 (SEQ ID NO: 183)
Second polypeptide (from N→C terminus, light chain of Ly368 and scFv
of TM559 in VH→VL orientation; SEQ ID NO: 192):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSEVQLVESGGGLVQPGGSLRLSCAASGFTFTNYGLHWVRQAP

GKGLEWVSSISPSGGVTYYRDSVKGRFTISRDNSKNTLYLQMNSLRAEDTAVYYCAKPFLGWGGANWIA

HWGQGTLVTVSSGGGGSGGGGSGGGGSGGGGSDIQMTQSPSSLSASVGDRVTITCLASEDISNDLAWYQ

QKPGKAPKLLIYFVDRLLDGVPSRFSGSGSGTDFTLTISSLQPEDFATYYCQQSYKYPPTFGQGTKLEI

K

Ly470
First polypeptide (from N→C terminus, heavy chain of Ly368 and scFv
of Ly253 in VL→VH orientation; SEQ ID NO: 193):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSDIQMTQSPSSVSASV

GDRVTITCRASQGIYSWLAWYQQKPGKAPNLLIYTASTLQSGVPSRFSGSGSGTDFTLTISSLQPEDFA

TYYCQQANIFPLTFGGGTKVEIKGGGGSGGGGSGGGGSGGGGSQVQLVQSGAEVKKPGASVKVSCKASG ytftgyymhwvrqapgqglewmgwinpdsggtnyaqkfqgrvtmtrdtsistaymelnrlrsddtavyy

CARDQPLGYCTNGVCSYFDYWGQGTLVTVSS

Second polypeptide: light chain of Ly368 (SEQ ID NO: 184)

Ly471
First polypeptide (from N→C terminus, heavy chain of Ly368 and scFv
of Ly253 in VH→VL orientation; SEQ ID NO: 194):
QVQLKESGPGLVAPSQSLSITCTVSGFSLTDYGVRWIRQPPGKGLEWLGVIWGGGSTYYNSALKSRLSI

SKDNSKSQVFLKMNSLQTDDTAMYYCAKEKRRGYYYAMDYWGQGTSVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSQVQLVQSGAEVKKPG

ASVKVSCKASGYTFTGYYMHWVRQAPGQGLEWMGWINPDSGGTNYAQKFQGRVTMTRDTSISTAYMELN

RLRSDDTAVYYCARDQPLGYCTNGVCSYFDYWGQGTLVTVSSGGGGSGGGGSGGGGSGGGGSDIQMTQS

PSSVSASVGDRVTITCRASQGIYSWLAWYQQKPGKAPNLLIYTASTLQSGVPSRFSGSGSGTDFTLTIS

SLQPEDFATYYCQQANIFPLTFGGGTKVEIK

-continued

```
Second polypeptide: light chain of Ly368 (SEQ ID NO: 184)

Ly472
First polypeptide: heavy chain of Ly368 (SEQ ID NO: 183)
Second polypeptide (from N→C terminus, light chain of Ly368 and scFv
of Ly253 in VL→VH orientation; SEQ ID NO: 195):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSVSASVGDRVTITCRASQGIYSWLAWYQQKPG

KAPNLLIYTASTLQSGVPSRFSGSGSGTDFTLTISSLQPEDFATYYCQQANIFPLTFGGGTKVEIKGGG

GSGGGGSGGGGSGGGGSQVQLVQSGAEVKKPGASVKVSCKASGYTFTGYYMHWVRQAPGQGLEWMGWIN

PDSGGTNYAQKFQGRVTMTRDTSISTAYMELNRLRSDDTAVYYCARDQPLGYCTNGVCSYFDYWGQGTL

VTVSS

Ly473
First polypeptide: heavy chain of Ly368 (SEQ ID NO: 183)
Second polypeptide (from N→C terminus, light chain of Ly368 and scFv
of Ly253 in VH→VL orientation; SEQ ID NO: 196):
ENVLTQSPAIMSASPGEKVTMTCRASSSVSSSYLHWYQQKSGASPKLWIYSTSNLASGVPARFSGSGSG

TSYSLTISSVEAEDAATYYCQQYSGYPLTFGGGTKLEIKRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSQVQLVQSGAEVKKPGASVKVSCKASGYTFTGYYMHWVRQAP

GQGLEWMGWINPDSGGTNYAQKFQGRVTMTRDTSISTAYMELNRLRSDDTAVYYCARDQPLGYCTNGVC

SYFDYWGQGTLVTVSSGGGGSGGGGSGGGGSGGGGSDIQMTQSPSSVSASVGDRVTITCRASQGIYSWL

AWYQQKPGKAPNLLIYTASTLQSGVPSRFSGSGSGTDFTLTISSLQPEDFATYYCQQANIFPLTFGGGT

KVEIK
```

Characterization of Anti-TNT/CD40 Bi-Specific Antibodies (i) Binding Activity

Anti-TNT/CD40 bi-specific antibodies are analyzed by FACS for their binding properties to human CD40 expressed on CHO cells or necrotic cells as a target (TNT). Briefly, necrotic cells were prepared by treated with 2% PFA for 10 mins at room temperature and acetone for 3 mins at –20° C. Then harvested CD40 expressing CHO cells or the necrotic cells, e.g., MC38, were resuspended in BSA-containing FACS stain buffer and further aliquoted 100 μL per well into a V-bottom 96-well plate. 50 μL of the bi-specific antibodies or corresponding IgG control were added to the cell-containing wells to obtain final concentrations of 0.1 μg/mL to 10 μg/mL. After incubation for 2 hours at 4° C., cells were centrifuged (3 min, 1000×g), washed with 250 μL/well BSA-containing FACS Stain Buffer, resuspended and incubated for an additional 1 hour at 4° C. with 100 μL/well fluorochrome-conjugated anti-IgG antibody for detection of the bispecific antibody. Cells were then washed with 250 μL/well BSA-containing FACS Stain Buffer, resuspended in 100 μL/well FACS Stain Buffer, acquired and analyzed using a FACS machine. Binding of the bispecific antibodies to TNT or human CD40 expressed on the CHO cells are evaluated and the mean fluorescence intensity is plotted in histograms or dot plots.

As shown in FIGS. 30A-30B, these antibodies exhibited similar binding affinity to necrotic MC38 cells relative to Ly368. As shown in FIGS. 31A-31B, these antibodies exhibited binding affinity to human CD40 expressed on CHO cells. Compared to the corresponding parental antibody, the binding activity of the bispecific antibodies having scFv formats of the CD40 antibodies remain minimally changed.

(ii) B Cell Proliferation

Exemplary anti-TNT/anti-CD40 bispecific antibodies were evaluated for the activity to stimulate the proliferation of human B cells following the procedures disclosed in Example 3 above. As shown in FIGS. 32A and 32B, these bispecific antibodies exhibited significant effect on the proliferation of B cells. It is noteworthy that the combination of TNT and CD40 leads the bispecific antibodies to exhibiting much greater activity in stimulating B cell proliferation, compared with all the other combination of bsAb targets cited in the current application.

Example 7: Anti-B7H3-CD40 Bi-Specific Antibodies

Preparation of Anti-B7H3 Antibodies

Anti-human B7H3 antibodies were generated using standard murine hybridoma technology. The amino acid sequences of the exemplary antibody Ly383 (hybridoma 18B11), and Ly387 (hybridoma 55E4) were analyzed and their CDR regions were identified following the Kabat CDR definitions. The VH and VL chains of the exemplary anti-B7H3 antibodies were shown below with the CDR regions identified in boldface. Chimeric antibodies comprising the VH/VL of the exemplary antibodies and human IgG1 and kappa chains were prepared and confirmed to show high affinity binding to B7H3.

>Ly383_VH
(SEQ ID NO: 45)
EVQLQQSGPELVKPGASVKMSCKASGYTFTSYVMHWVKQKPGQGLEWIG

YINPYNDGTECTDKFKGKATLTSDKSSSTAYMELSSLTSEDSAVYYCAS

IYYGYDGTYFGVWGAGTSVTVSS

>Ly383_VL
(SEQ ID NO: 46)
QIVLSQSPAILSTSPGEKVTMTCRASSSVSYMHWYQQKPGSSPKPWIYA

TSNLASGVPARFSGSRSGTSYSLTISRVEAEDAATYYCQQWSSNTLTFG

GGTKLELK

>Ly387_VH
(SEQ ID NO: 47)
QVQLQQPGAELVKPGASVKLSCKASGYTFTSYWMHWVKQRPGQGLEWIG

MIHPNSGGTNYNEKFKGKGTLTVDKSSSTAYMQLSSLTSDDSAVYYCVT

SQATWFAYWGQGTLVTVSA

>Ly387_VL
(SEQ ID NO: 48)
ENVLTQSPAIMSVSPGEKVTMTCRASSSVSSSYLHWYQQKSGASPKFWI

YSTSNLASGVPARFSGSGSGTSYSLTISSVEAEDAATYYCQHYSGYPLT

FGAGTKLELR

Preparation of Anti-B7H3/CD40 Bi-Specific Antibodies

Anti-B7H3/CD40 bi-specific antibodies were produced using the human or humanized anti-CD40 antibodies and anti-B7H3 antibodies exemplified above. cDNAs encoding the VH and VL chains of the anti-B7H3 antibodies and the VH and VL chains of the anti-CD40 antibodies were used as the starting materials. CHO-cell transient expression was carried out using plasmids configured for expressing poly-peptides of the bi-specific antibodies. These antibodies were purified by protein A affinity chromatography.

The amino acid sequences of the heavy chain (HC) and the light chain (LC) of the anti-B7H3 chimeric antibody and the amino acid sequences of the polypeptides of the bi-specific antibodies are provided below:

Ly383
Heavy chain (SEQ ID NO: 197):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKL

TVDKSRWQQGNVFSCSVMHEALHNHYTQKSLSLSPGK

Light chain (SEQ ID NO: 198):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGEC

Ly387
Heavy chain (SEQ ID NO: 199):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTPPVLDSDGSFFLYSKLTVDK

SRWQQGNVFSCSVMHEALHNHYTQKSLSLSPGK

Light chain (SEQ ID NO: 200):
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGEC

-continued

Ly610
First polypeptide (from N→C terminus, heavy chain of Ly383 with IgG1
mutated Fc region and scFv of TM740 in VL→VH orientation; SEQ ID NO:
201):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSDIQMTQSPSSLSAS

VGDRVTITCKASQNIYIYLNWYQQKPGKAPKLLIYNTNNLQTGVPSRFSGSGSGTDFTLTISSLQPEDF

ATYYCLQHSSRRTFGGGTKVEIKGGGGSGGGGSGGGGSGGGGSQVQLVESGGGLVQPGGSLKLSCATSG

FNFNDYFMNWVRQASGKGLEWVGQIRNKNYNYATYYTESLEGRVTISRDDSKNTAYLQMNSLKTEDTAV

YYCTSYYYDGFADYFDYWGQGTTVTVSS

Second polypeptide: light chain of Ly383 (SEQ ID NO: 198)

Ly611
First polypeptide (from N→C terminus, heavy chain of Ly383 with IgG1
mutated Fc region and scFv of TM740 in VH→VL orientation; SEQ ID NO:
202):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSQVQLVESGGGLVQP

GGSLKLSCATSGFNFNDYFMNWVRQASGKGLEWVGQIRNKNYNYATYYTESLEGRVTISRDDSKNTAYL

QMNSLKTEDTAVYYCTSYYYDGFADYFDYWGQGTTVTVSSGGGGSGGGGSGGGGSGGGGSDIQMTQSPS

SLSASVGDRVTITCKASQNIYIYLNWYQQKPGKAPKLLIYNTNNLQTGVPSRFSGSGSGTDFTLTISSL

QPEDFATYYCLQHSSRRTFGGGTKVEIK

Second polypeptide: light chain of Ly383 (SEQ ID NO: 198)

Ly612
First polypeptide (from N→C terminus, heavy chain of Ly383 with IgG1
mutated Fc region and scFv of TM559 in VL→VH orientation; SEQ ID NO:
203):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSDIQMTQSPSSLSAS

VGDRVTITCLASEDISNDLAWYQQKPGKAPKLLIYFVDRLLDGVPSRFSGSGSGTDFTLTISSLQPEDF

-continued

ATYYCQQSYKYPPTFGQGTKLEIKGGGGSGGGGSGGGGSGGGGSEVQLVESGGGLVQPGGSLRLSCAAS

GFTFTNYGLHWVRQAPGKGLEWVSSISPSGGVTYYRDSVKGRFTISRDNSKNTLYLQMNSLRAEDTAVY

YCAKPFLGWGGANWIAHWGQGTLVTVSS

Second polypeptide: light chain of Ly383 (SEQ ID NO: 198)

Ly613
First polypeptide (from N→C terminus, heavy chain of Ly383 with IgG1
mutated Fc region and scFv of TM559 in VH→VL orientation; SEQ ID NO:
204):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSEVQLVESGGGLVQP

GGSLRLSCAASGFTFTNYGLHWVRQAPGKGLEWVSSISPSGGVTYYRDSVKGRFTISRDNSKNTLYLQM

NSLRAEDTAVYYCAKPFLGWGGANWIAHWGQGTLVTVSSGGGGSGGGGSGGGGSGGGGSDIQMTQSPSS

LSASVGDRVTITCLASEDISNDLAWYQQKPGKAPKLLIYFVDRLLDGVPSRFSGSGSGTDFTLTISSLQ

PEDFATYYCQQSYKYPPTFGQGTKLEIK

Second polypeptide: light chain of Ly383 (SEQ ID NO: 198)

Ly614
First polypeptide (from N→C terminus, heavy chain of Ly387 with IgG1
mutated Fc region and scFv of TM740 in VL→VH orientation; SEQ ID NO:
205):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGSGGGGSGGGGSGGGGSDIQMTQSPSSLSASVGDR

VTITCKASQNIYIYLNWYQQKPGKAPKLLIYNTNNLQTGVPSRFSGSGSGTDFTLTISSLQPEDFATYY

CLQHSSRRTFGGGTKVEIKGGGGSGGGGSGGGGSGGGGSQVQLVESGGGLVQPGGSLKLSCATSGFNFN

DYFMNWVRQASGKGLEWVGQIRNKNYNYATYYTESLEGRVTISRDDSKNTAYLQMNSLKTEDTAVYYCT

SYYYDGFADYFDYWGQGTTVTVSS

Second polypeptide: light chain of Ly387 (SEQ ID NO: 200)

Ly615
First polypeptide (from N→C terminus, heavy chain of Ly387 with IgG1
mutated Fc region and scFv of TM740 in VH→VL orientation; SEQ ID NO:
206):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

-continued

RWQQGNVFSCSVMHEALHNHYTQKSLSLSPGGGGSGGGGSGGGGSGGGGSQVQLVESGGGLVQPGGSL

KLSCATSGFNFNDYFMNWVRQASGKGLEWVGQIRNKNYNYATYYTESLEGRVTISRDDSKNTAYLQMNS

LKTEDTAVYYCTSYYYDGFADYFDYWGQGTTVTVSSGGGGSGGGGSGGGGSGGGGSDIQMTQSPSSLSA

SVGDRVTITCKASQNIYIYLNWYQQKPGKAPKLLIYNTNNLQTGVPSRFSGSGSGTDFTLTISSLQPED

FATYYCLQHSSRRTFGGGTKVEIK

Second polypeptide: light chain of Ly387 (SEQ ID NO: 200)

Ly616
First polypeptide (from N→C terminus, heavy chain of Ly387 with IgG1
mutated Fc region and scFv of TM559 in VL→VH orientation; SEQ ID NO:
207):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGSGGGGSGGGGSGGGGSDIQMTQSPSSLSASVGDR

VTITCLASEDISNDLAWYQQKPGKAPKLLIYFVDRLLDGVPSRFSGSGSGTDFTLTISSLQPEDFATYY

CQQSYKYPPTFGQGTKLEIKGGGGSGGGGSGGGGSGGGGSEVQLVESGGGLVQPGGSLRLSCAASGFTF

TNYGLHWVRQAPGKGLEWVSSISPSGGVTYYRDSVKGRFTISRDNSKNTLYLQMNSLRAEDTAVYYCAK

PFLGWGGANWIAHWGQGTLVTVSS

Second polypeptide: light chain of Ly387 (SEQ ID NO: 200)

Ly617
First polypeptide (from N→C terminus, heavy chain of Ly387 with IgG1
mutated Fc region and scFv of TM559 in VH→VL orientation; SEQ ID NO:
208):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGSGGGGSGGGGSGGGGSEVQLVESGGGLVQPGGSL

RLSCAASGFTFTNYGLHWVRQAPGKGLEWVSSISPSGGVTYYRDSVKGRFTISRDNSKNTLYLQMNSLR

AEDTAVYYCAKPFLGWGGANWIAHWGQGTLVTVSSGGGGSGGGGSGGGGSGGGGSDIQMTQSPSSLSAS

VGDRVTITCLASEDISNDLAWYQQKPGKAPKLLIYFVDRLLDGVPSRFSGSGSGTDFTLTISSLQPEDF

ATYYCQQSYKYPPTFGQGTKLEIK

Second polypeptide: light chain of Ly387 (SEQ ID NO: 200)

Ly801
First polypeptide: heavy chain of Ly383 with IgG1 mutated Fc (SEQ ID
NO: 209):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

-continued

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPG

Second polypeptide (from N→C terminus, light chain of Ly383 and scFv
of TM740 in VL→VH orientation; SEQ ID NO: 210):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCKASQNIYIYLNWYQQKPGKA

GGGSGGGGSGGGGSQVQLVESGGGLVQPGGSLKLSCATSGFNFNDYFMNWVRQASGKGLEWVGQIRNKN

YNYATYYTESLEGRVTISRDDSKNTAYLQMNSLKTEDTAVYYCTSYYYDGFADYFDYWGQGTTVTVSS

Ly802
First polypeptide: heavy chain of Ly801 (SEQ ID NO: 209)
Second polypeptide (from N→C terminus, light chain of Ly383 and scFv
of TM740 in VH→VL orientation; SEQ ID NO: 211):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVESGGGLVQPGGSLKLSCATSGFNFNDYFMNWVRQASGK

GLEWVGQIRNKNYNYATYYTESLEGRVTISRDDSKNTAYLQMNSLKTEDTAVYYCTSYYYDGFADYFDY

WGQGTTVTVSSGGGGSGGGGSGGGGSGGGGSDIQMTQSPSSLSASVGDRVTITCKASQNIYIYLNWYQQ

KPGKAPKLLIYNTNNLQTGVPSRFSGSGSGTDFTLTISSLQPEDFATYYCLQHSSRRTFGGGTKVEIK

Ly803
First polypeptide: heavy chain of Ly801 (SEQ ID NO: 209)
Second polypeptide (from N→C terminus, light chain of Ly383 and scFv
of TM559 in VL→VH orientation; SEQ ID NO: 212):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCLASEDISNDLAWYQQKPGKA

PKLLIYFVDRLLDGVPSRFSGSGSGTDFTLTISSLQPEDFATYYCQQSYKYPPTFGQGTKLEIKGGGGS

GGGGSGGGGSGGGGSEVQLVESGGGLVQPGGSLRLSCAASGFTFTNYGLHWVRQAPGKGLEWVSSISPS

GGVTYYRDSVKGRFTISRDNSKNTLYLQMNSLRAEDTAVYYCAKPFLGWGGANWIAHWGQGTLVTVSS

Ly804
First polypeptide: heavy chain of Ly801 (SEQ ID NO: 209)
Second polypeptide (from N→C terminus, light chain of Ly383 and scFv
of TM559 in V→VL orientation; SEQ ID NO: 213):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSEVQLVESGGGLVQPGGSLRLSCAASGFTFTNYGLHWVRQAPGK

GLEWVSSISPSGGVTYYRDSVKGRFTISRDNSKNTLYLQMNSLRAEDTAVYYCAKPFLGWGGANWIAHW

GQGTLVTVSSGGGGSGGGGSGGGGSGGGGSDIQMTQSPSSLSASVGDRVTITCLASEDISNDLAWYQQK

PGKAPKLLIYFVDRLLDGVPSRFSGSGSGTDFTLTISSLQPEDFATYYCQQSYKYPPTFGQGTKLEIK

Ly805
First polypeptide: heavy chain of Ly387 with IgG1 mutated Fc (SEQ ID
NO: 214):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

-continued

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPG

Second polypeptide (from N→C terminus, light chain of Ly387 and scFv
of TM740 in VL→VH orientation; SEQ ID NO: 215):
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSLSASVGDRVTITCKASQNIYIYLNWYQQKPG

KAPKLLIYNTNNLQTGVPSRFSGSGSGTDFTLTISSLQPEDFATYYCLQHSSRRTFGGGTKVEIKGGGG

SGGGGSGGGGSGGGGSQVQLVESGGGLVQPGGSLKLSCATSGFNFNDYFMNWVRQASGKGLEWVGQIRN

KNYNYATYYTESLEGRVTISRDDSKNTAYLQMNSLKTEDTAVYYCTSYYYDGFADYFDYWGQGTTVTVS

S

Ly806
First polypeptide: heavy chain of Ly805 (SEQ ID NO: 214)
Second polypeptide (from N→C terminus, light chain of Ly387 and scFv
of TM740 in VH→VL orientation; SEQ ID NO: 216):
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSQVQLVESGGGLVQPGGSLKLSCATSGFNFNDYFMNWVRQAS

GKGLEWVGQIRNKNYNYATYYTESLEGRVTISRDDSKNTAYLQMNSLKTEDTAVYYCTSYYYDGFADYF

DYWGQGTTVTVSSGGGGSGGGGSGGGGSGGGGSDIQMTQSPSSLSASVGDRVTITCKASQNIYIYLNWY

QQKPGKAPKLLIYNTNNLQTGVPSRFSGSGSGTDFTLTISSLQPEDFATYYCLQHSSRRTFGGGTKVEI

K

Ly807
First polypeptide: heavy chain of Ly805 (SEQ ID NO: 214)
Second polypeptide (from N→C terminus, light chain of Ly387 and scFv
of TM559 in VL→VH orientation; SEQ ID NO: 217):
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSLSASVGDRVTITCLASEDISNDLAWYQQKPG

KAPKLLIYFVDRLLDGVPSRFSGSGSGTDFTLTISSLQPEDFATYYCQQSYKYPPTFGQGTKLEIKGGG

GSGGGGSGGGGSGGGGSEVQLVESGGGLVQPGGSLRLSCAASGFTFTNYGLHWVRQAPGKGLEWVSSIS

PSGGVTYYRDSVKGRFTISRDNSKNTLYLQMNSLRAEDTAVYYCAKPFLGWGGANWIAHWGQGTLVTVS

S

Ly808
First polypeptide: heavy chain of Ly805 (SEQ ID NO: 214)
Second polypeptide (from N→C terminus, light chain of Ly387 and scFv
of TM559 in VH→VL orientation; SEQ ID NO: 218):
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSEVQLVESGGGLVQPGGSLRLSCAASGFTFTNYGLHWVRQAP

GKGLEWVSSISPSGGVTYYRDSVKGRFTISRDNSKNTLYLQMNSLRAEDTAVYYCAKPFLGWGGANWIA

-continued

HWGQGTLVTVSSGGGGSGGGGSGGGGSGGGGSDIQMTQSPSSLSASVGDRVTITCLASEDISNDLAWYQ

QKPGKAPKLLIYFVDRLLDGVPSRFSGSGSGTDFTLTISSLQPEDFATYYCQQSYKYPPTFGQGTKLEI

K

Ly809
First polypeptide (from N→C terminus, heavy chain of Ly383 with IgG1
mutated Fc region and scFv of Ly253 in VL→VH orientation; SEQ ID NO:
219):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSDIQMTQSPSSVSAS

VGDRVTITCRASQGIYSWLAWYQQKPGKAPNLLIYTASTLQSGVPSRFSGSGSGTDFTLTISSLQPEDF

ATYYCQQANIFPLTFGGGTKVEIKGGGGSGGGGSGGGGSGGGGSQVQLVQSGAEVKKPGASVKVSCKAS

GYTFTGYYMHWVRQAPGQGLEWMGWINPDSGGTNYAQKFQGRVTMTRDTSISTAYMELNRLRSDDTAVY

YCARDQPLGYCTNGVCSYFDYWGQGTLVTVSS

Second polypeptide: light chain of Ly383 (SEQ ID NO: 198)

Ly810
First polypeptide (from N→C terminus, heavy chain of Ly383 with IgG1
mutated Fc region and scFv of Ly253 in VH→VL orientation; SEQ ID NO:
220):
EVQLQQSGPELVKPGASVKMSCKASGYTFTSYVMHWVKQKPGQGLEWIGYINPYNDGTECTDKFKGKAT

LTSDKSSSTAYMELSSLTSEDSAVYYCASIYYGYDGTYFGVWGAGTSVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSQVQLVQSGAEVKKP

GASVKVSCKASGYTFTGYYMHWVRQAPGQGLEWMGWINPDSGGTNYAQKFQGRVTMTRDTSISTAYMEL

NRLRSDDTAVYYCARDQPLGYCTNGVCSYFDYWGQGTLVTVSSGGGGSGGGGSGGGGSGGGGSDIQMTQ

SPSSVSASVGDRVTITCRASQGIYSWLAWYQQKPGKAPNLLIYTASTLQSGVPSRFSGSGSGTDFTLTI

SSLQPEDFATYYCQQANIFPLTFGGGTKVEIK

Second polypeptide: light chain of Ly383 (SEQ ID NO: 198)

Ly811
First polypeptide: heavy chain of Ly801 (SEQ ID NO: 214)
Second polypeptide (from N→C terminus, light chain of Ly383 and scFv
of Ly253 in VL→VH orientation; SEQ ID NO: 221):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSVSASVGDRVTITCRASQGIYSWLAWYQQKPGKA

PNLLIYTASTLQSGVPSRFSGSGSGTDFTLTISSLQPEDFATYYCQQANIFPLTFGGGTKVEIKGGGGS

-continued

GGGGSGGGGSGGGGSQVQLVQSGAEVKKPGASVKVSCKASGYTFTGYYMHWVRQAPGQGLEWMGWINPD

SGGTNYAQKFQGRVTMTRDTSISTAYMELNRLRSDDTAVYYCARDQPLGYCTNGVCSYFDYWGQGTLVT

VSS

Ly812
First polypeptide: heavy chain of Ly801 (SEQ ID NO: 214)
Second polypeptide (from N→C terminus, light chain of Ly383 and scFv
of Ly253 in VH→VL orientation; SEQ ID NO: 222):
QIVLSQSPAILSTSPGEKVTMTCRASSSVSYMHWYQQKPGSSPKPWIYATSNLASGVPARFSGSRSGTS

YSLTISRVEAEDAATYYCQQWSSNTLTFGGGTKLELKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVQSGAEVKKPGASVKVSCKASGYTFTGYYMHWVRQAPGQ

GLEWMGWINPDSGGTNYAQKFQGRVTMTRDTSISTAYMELNRLRSDDTAVYYCARDQPLGYCTNGVCSY

FDYWGQGTLVTVSSGGGGSGGGGSGGGGSGGGGSDIQMTQSPSSVSASVGDRVTITCRASQGIYSWLAW

YQQKPGKAPNLLIYTASTLQSGVPSRFSGSGSGTDFTLTISSLQPEDFATYYCQQANIFPLTFGGGTKV

EIK

Ly813
First polypeptide (from N→C terminus, heavy chain of Ly387 with IgG1
mutated Fc region and scFv of Ly253 in VL→VH orientation; SEQ ID NO:
223):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGSGGGGSGGGGSGGGGSDIQMTQSPSSVSASVGDR

VTITCRASQGIYSWLAWYQQKPGKAPNLLIYTASTLQSGVPSRFSGSGSGTDFTLTISSLQPEDFATYY

CQQANIFPLTFGGGTKVEIKGGGGSGGGGSGGGGSGGGGSQVQLVQSGAEVKKPGASVKVSCKASGYTF

TGYYMHWVRQAPGQGLEWMGWINPDSGGTNYAQKFQGRVTMTRDTSISTAYMELNRLRSDDTAVYYCAR

DQPLGYCTNGVCSYFDYWGQGTLVTVSS

Second polypeptide: light chain of Ly387 (SEQ ID NO: 200)

Ly814
First polypeptide (from N→C terminus, light chain of Ly387 and scFv
of Ly253 in VH→VL orientation; SEQ ID NO: 224):
QVQLQQPGAELVKPGASVKLSCKASGYTFTSYWMHWVKQRPGQGLEWIGMIHPNSGGTNYNEKFKGKGT

LTVDKSSSTAYMQLSSLTSDDSAVYYCVTSQATWFAYWGQGTLVTVSAASTKGPSVFPLAPSSKSTSGG

TAALGCLVKDYFPEPVTVSWNSGALTSGVHTFPAVLQSSGLYSLSSVVTVPSSSLGTQTYICNVNHKPS

NTKVDKKVEPKSCDKTHTCPPCPAPELLGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGGGGSGGGGSGGGGSGGGGSQVQLVQSGAEVKKPGASV

KVSCKASGYTFTGYYMHWVRQAPGQGLEWMGWINPDSGGTNYAQKFQGRVTMTRDTSISTAYMELNRLR

SDDTAVYYCARDQPLGYCTNGVCSYFDYWGQGTLVTVSSGGGGSGGGGSGGGGSGGGGSDIQMTQSPSS

VSASVGDRVTITCRASQGIYSWLAWYQQKPGKAPNLLIYTASTLQSGVPSRFSGSGSGTDFTLTISSLQ

PEDFATYYCQQANIFPLTFGGGTKVEIK

-continued

Second polypeptide: light chain of Ly387 (SEQ ID NO: 200)

Ly815
First polypeptide: heavy chain of Ly805 (SEQ ID NO: 214)
Second polypeptide (from N→C terminus, light chain of Ly387 and scFv
of Ly253 in VL→VH orientation; SEQ ID NO: 225):
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSDIQMTQSPSSVSASVGDRVTITCRASQGIYSWLAWYQQKPG

KAPNLLIYTASTLQSGVPSRFSGSGSGTDFTLTISSLQPEDFATYYCQQANIFPLTFGGGTKVEIKGGG

GSGGGGSGGGGSGGGGSQVQLVQSGAEVKKPGASVKVSCKASGYTFTGYYMHWVRQAPGQGLEWMGWIN

PDSGGTNYAQKFQGRVTMTRDTSISTAYMELNRLRSDDTAVYYCARDQPLGYCTNGVCSYFDYWGQGTL

VTVSS

Ly816
First polypeptide: heavy chain of Ly805 (SEQ ID NO: 214)
Second polypeptide (from N→C terminus, light chain of Ly387 and scFv
of Ly253 in VH→VL orientation; SEQ ID NO: 226)
ENVLTQSPAIMSVSPGEKVTMTCRASSSVSSSYLHWYQQKSGASPKFWIYSTSNLASGVPARFSGSGSG

TSYSLTISSVEAEDAATYYCQHYSGYPLTFGAGTKLELRRTVAAPSVFIFPPSDEQLKSGTASVVCLLN

NFYPREAKVQWKVDNALQSGNSQESVTEQDSKDSTYSLSSTLTLSKADYEKHKVYACEVTHQGLSSPVT

KSFNRGECGGGGSGGGGSGGGGSGGGGSQVQLVQSGAEVKKPGASVKVSCKASGYTFTGYYMHWVRQAP

GQGLEWMGWINPDSGGTNYAQKFQGRVTMTRDTSISTAYMELNRLRSDDTAVYYCARDQPLGYCTNGVC

SYFDYWGQGTLVTVSSGGGGSGGGGSGGGGSGGGGSDIQMTQSPSSVSASVGDRVTITCRASQGIYSWL

AWYQQKPGKAPNLLIYTASTLQSGVPSRFSGSGSGTDFTLTISSLQPEDFATYYCQQANIFPLTFGGGT

KVEIK

These bispecific antibodies are to be evaluated for their in vitro and in vivo activity, including binding to target antigen (B7H3 and CD40), agonistic activity in a CD40 reporter assay system, activation of B cell and DC cell, anti-tumor activity in mouse models.

Characterization of Anti-B7H3/CD40 Bi-Specific Antibodies (i) Binding Activity

Exemplary anti-B7H3/anti-CD40 bi-specific antibodies were analyzed by FACS for their binding properties to human B7H3 and/or human CD40 expressed on CHO cells. Briefly, cultured cells were harvested, counted and cell viability was evaluated using the Trypan Blue exclusion method. Viable cells were then adjusted to $2\times10^6$ cells per mL in PBS containing 2% BSA. 100 μL of this cell suspension were further aliquoted per well into a V-bottom 96-well plate. 50 μL of the bi-specific antibodies or corresponding IgG control were added to the cell-containing wells to obtain final concentrations of 0.1 μg/mL to 10 μg/mL. After incubation for 2 hours at 4° C., cells were centrifuged (3 min, 1000×g), washed with 250 μL/well BSA-containing FACS Stain Buffer, resuspended and incubated for an additional 1 hour at 4° C. with 100 μL/well fluorochrome-conjugated anti-IgG antibody for detection of the bispecific antibody. Cells were then washed with 250 μL/well BSA-containing FACS Stain Buffer, resuspended in 100 μL/well FACS Stain Buffer, acquired and analyzed using a FACS machine. Binding of the bispecific antibodies to human B7H3 or human CD40 expressing CHO cells were evaluated and the mean fluorescence intensity is plotted in histograms or dot plots.

As shown in FIGS. 33A-33C, the exemplary anti-B7H3/CD40 bi-specific antibodies exhibited similar binding affinity to human B7H3 expressed on the CHO cells overexpressing such as Ly383 and Ly387. As shown in FIGS. 34A-34C, the bi-specific antibodies exhibited binding affinity to human CD40 expressed on CHO cells. Compared to the corresponding parental antibody, the binding activity of bi-specific antibodies comprising scFv formats of the CD40 antibodies remain minimally changed.

Anti-B7H3/CD40 bi-specific antibodies were analyzed by ELISA for their simultaneous binding to recombinant human B7H3 and human CD40. Briefly, Human B7H3 CD protein (His-tag) was diluted and coated onto an ELISA plate with a volume of 100/well by incubation at 4° C. overnight. The next day, the plate was blocked with PBST-BSA buffer, then serially diluted samples of anti-B7H3/CD40 bi-specific antibodies were pipetted into appropriate wells at 50 μL/well, and the plate was incubated for 1 h followed by washing. Human CD40-msFc antibody was added into the plate at 50 μL/well. After 1-hour incubation at room temperature, ECD protein (mouse IgG2a Fc tag) anti-Mouse IgG (H+L) antibody was added into the plate at 100 μL/well. The plate was incubated for 1 hour at room temperature followed by washing. TMB substrate solution was added at 100 L/well and the color development was stopped by adding 100 μL/well Stop Solution (2N $H_2SO_4$). Absorbance at 450 nm and 620 nm was read by Tecan F200 Pro plate reader. GraphPad 7.0, "[Agonist] vs. response—Variable slope (four parameters)" was used to plot the binding data and calculate binding EC50 values.

Figure 35A:
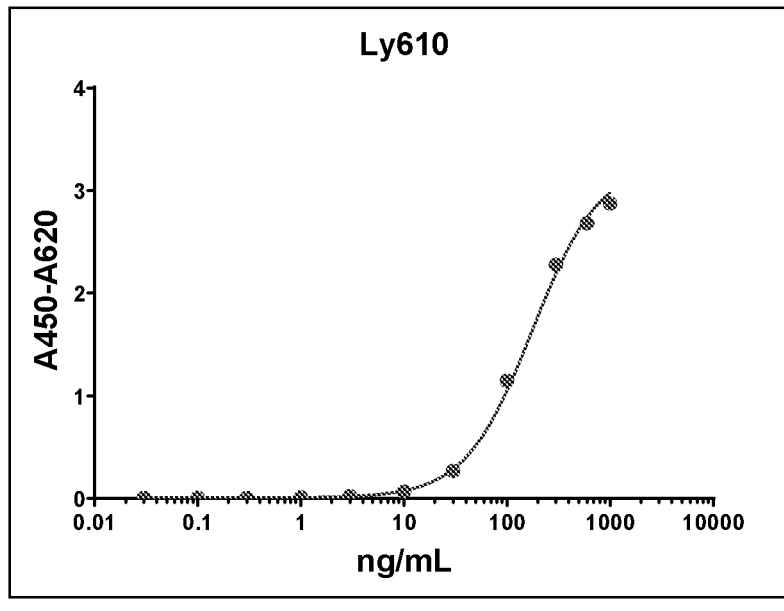
Figure 35B:
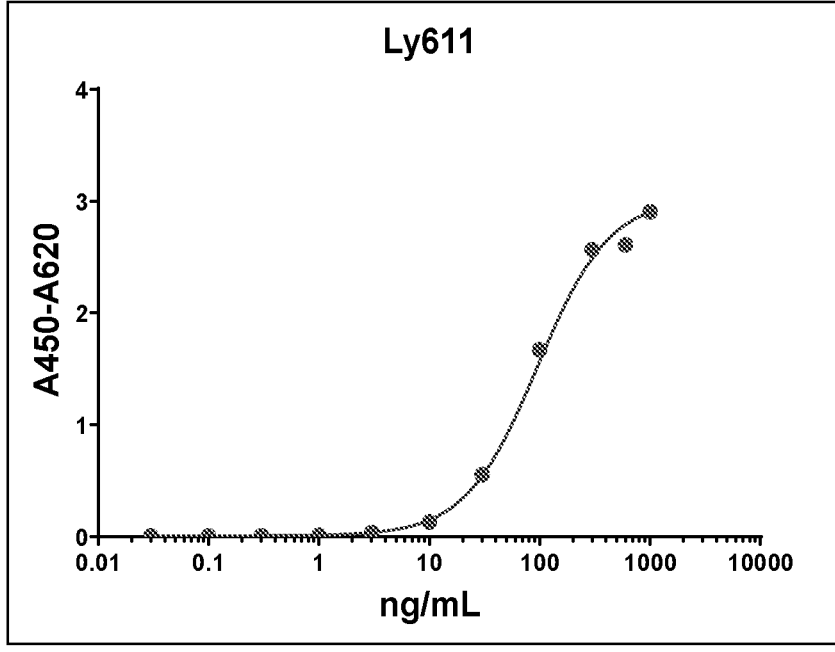
Figure 35C:
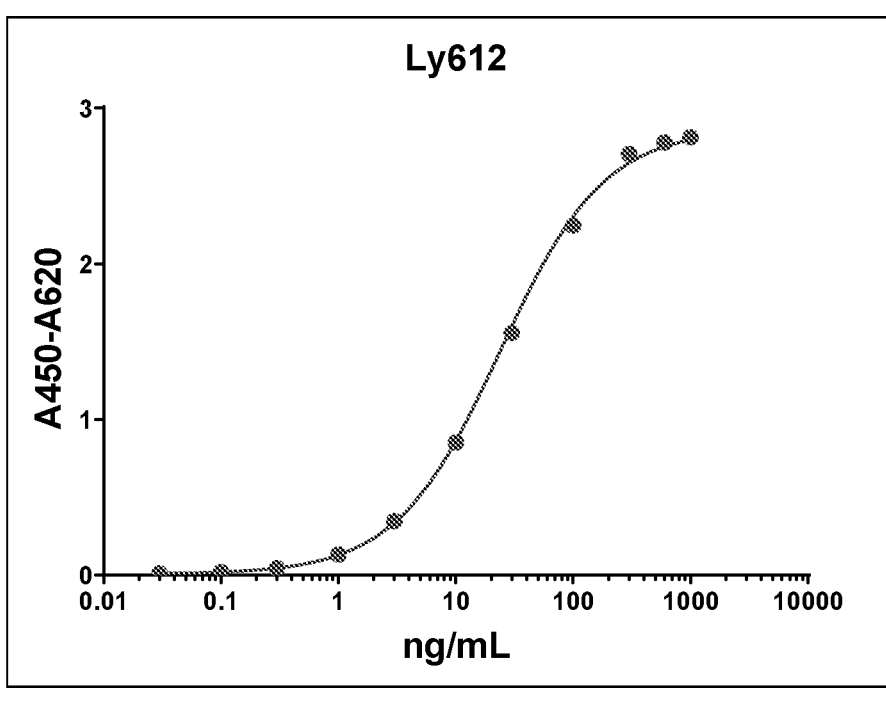
Figure 35D:
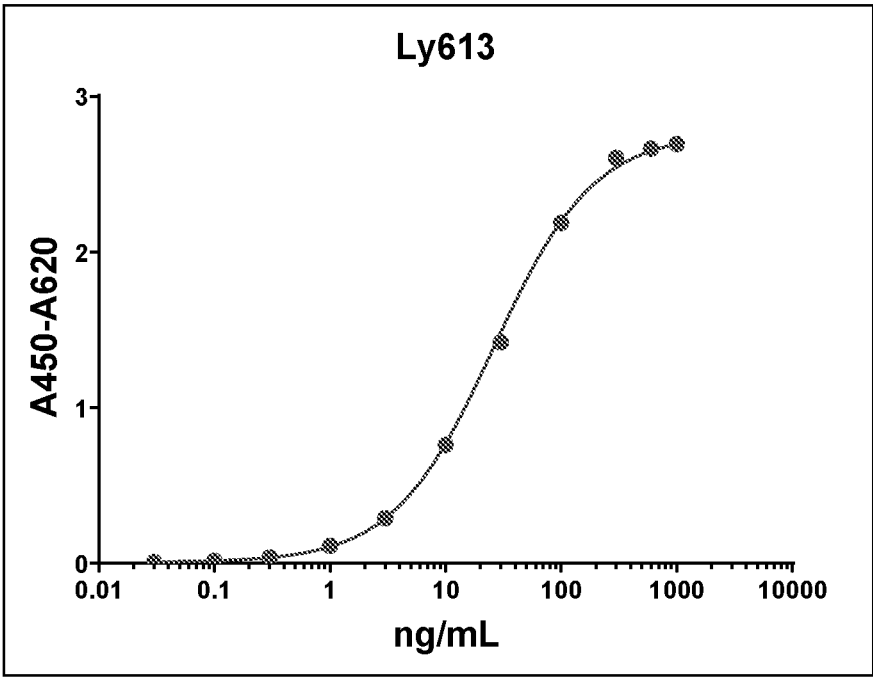
Figure 35E:
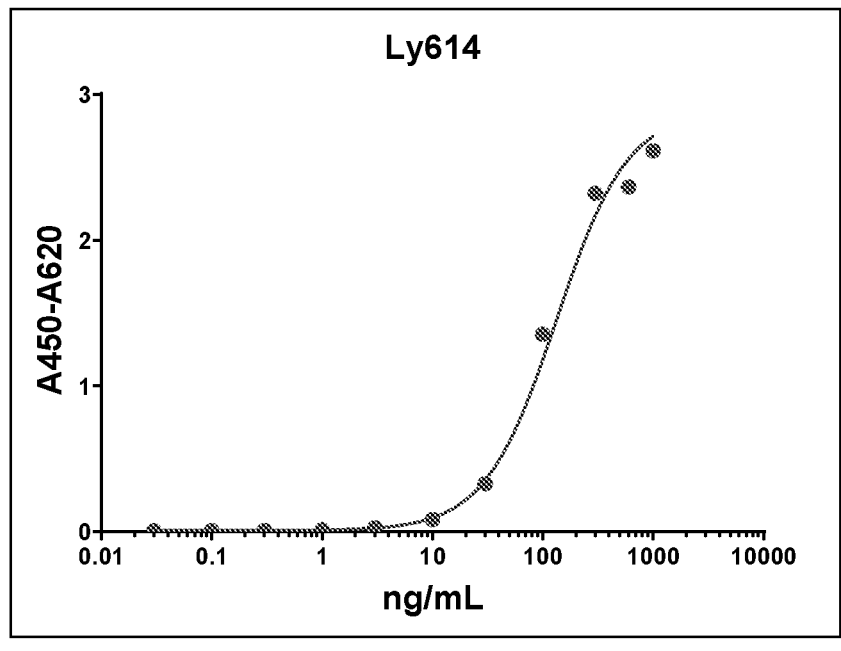
Figure 35F:
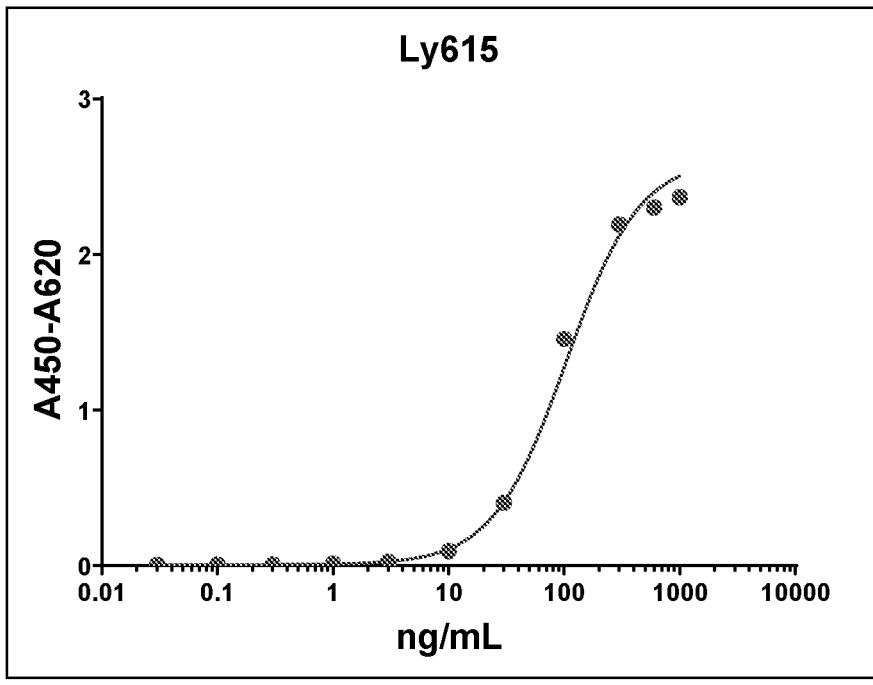
Figure 35G:
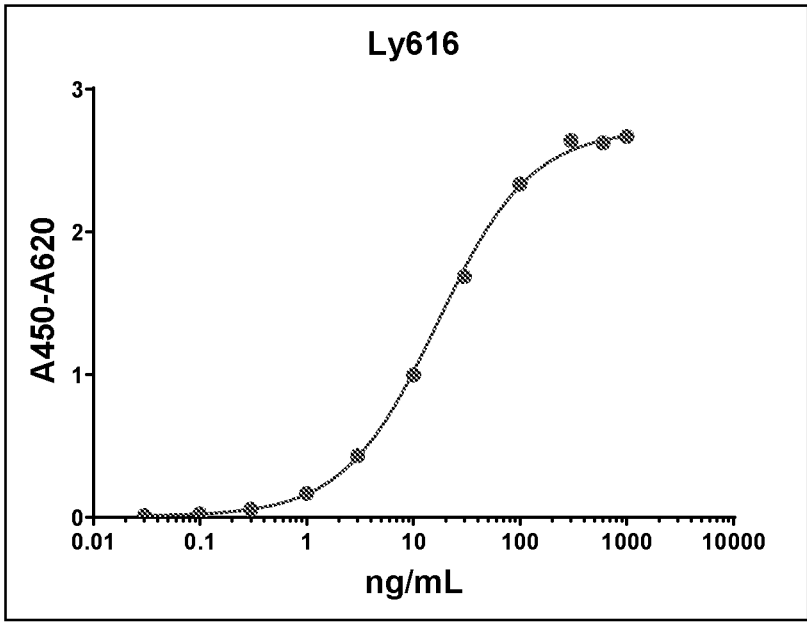
Figure 35H:
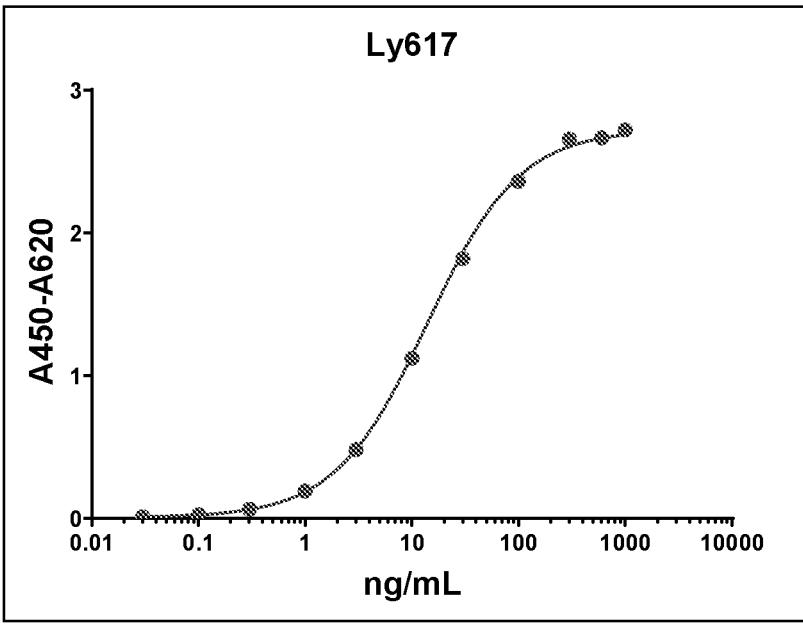

As shown in FIGS. 35A-35B, the exemplary anti-B7H3/CD40 bi-specific antibodies simultaneously binded to recombinant human B7H3 and human CD40.

(ii) Agonistic Activity for CD40

The CD40 reporter assay disclosed herein was used to determine the agonist activity of the bispecific antibodies, following the same procedures disclosed in Example 2 above. The CD40 reporter assay was also performed in co-culture with B7H3-expressing CHO cells.

As shown in FIG. 36, panels A-M, the bi-specific antibodies in solution showed a various degree of CD40 agonist activity. The agonist activity was greatly enhanced in the co-culture assay, as indicated by the saturation of dose response where lowest concentration of 0.01 µg/mL bispecific antibodies exhibited maximal activity. Binding to both CD40 and B7H3 by the tested bi-specific antibodies simultaneously in a microenvironment would affect individual binding due to the avidity effect, which refers to the accumulated strength of multiple affinities of individual non-covalent binding interactions. The bi-specific antibodies showed increased activity when co-cultured with B7H3-expressing CHO cells. Therefore, binding profile to human B7H3 and CD40 would affect the agonist activity of these bi-specific antibodies.

(iii) B Cell Proliferation

Anti-B7H3/CD40 bispecific antibodies were evaluated for the activity to stimulate the proliferation of human B cells following the procedures disclosed in Example 3 above. As shown in FIGS. 37A-37D, these bi-specific antibodies exhibited distinct profile on the proliferation of B cells. It is of interest to note that bi-specific antibodies Ly612, Ly613, Ly801, Ly802, Ly803, Ly804, Ly809, Ly811, Ly812, Ly615, Ly616, Ly617, Ly807, and Ly815 showed no stimulation of B cell proliferation.

(iv) Dendritic Cell Activation

The anti-B7H3/CD40 antibodies were tested in vitro for CD40 binding activities and agonistic activity as described in Examples above. Their activities in activating human dendritic cells were carried out as described in Example 3 above. The DC activation assay was also performed in co-culture with B7H3 expressing CHO cells.

As shown FIGS. 38A-38D, the tested exemplary anti-B7H3/CD40 antibodies stimulated DC activation at various degrees as evidenced by the secretion of IL8 from the DC culture after antibody incubation. The magnitude of DC activation was increased, likely due to binding of CD40 and B7H4 by the bispecific antibody molecules simultaneously in a microenvironment, which would affect individual binding due to avidity effect leading to alteration of CD40 agonistic effect of the antibodies.

(v) Pharmacokinetic Studies of Anti-B7H3/Anti-CD40 Bi-Specific Antibodies

C57BL/6 mice (6-7 weeks old, 19-20 g, male, purchased from SLAC Laboratory Animal Co. LTD) were used for the study. Antibodies were formulated in PBS and administered via tail vein injection at 3 mg/kg in a group of 4 mice.

Blood sampling was done at pre-dose, 1d, 4d, 7d, 10d, 14d, 17d and 21d by serial bleeding. 10 µL blood per time point was added to 40 µL of a PBS-BSA solution. The sample was then mixed well and centrifuged at 2000 g for 5 minutes at 4° C. The supernatant was put on dry ice immediately after collection and stored at approximately −70° C. until analysis.

Blood antibody concentrations were determined by ELISA. FIGS. 39A-39H showed the blood concentrations of the bispecific antibodies after a single intravenous injection of 3 mg/kg. These bispecific antibodies showed high and lasting circulation concentrations.

Example 8: Anti-PD-1/CD40 Bi-Specific Antibodies

Anti-PD-1/CD40 bi-specific antibodies were produced using the human or humanized anti-CD40 antibodies exemplified above. cDNAs encoding VH and VL chains of an anti-PD-1 antibody and those of anti-CD40 were used as the starting materials. CHO-cell transient expression was carried out with plasmids configured for expressing polypeptide chains of the bi-specific antibodies. These antibodies were purified by protein A affinity chromatography.

The amino acid sequences of the heavy chain (HC) and the light chain (LC) of the anti-PD-1 antibody (Ly516) and of the polypeptides of the bi-specific antibodies are provided below:

```
Ly516
Heavy chain (SEQ ID NO: 227):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPCSRS

TSESTAALGCLVKDYFPEPVTVSWNSGALTSGVHTFPAVLQSSGLYSLSSVVTVPSSSLGTKTYTCNVD

HKPSNTKVDKRVESKYGPPCPPCPAPEFLGGPSVFLFPPKPKDTLMISRTPEVTCVVVDVSQEDPEVQF

NWYVDGVEVHNAKTKPREEQFNSTYRVVSVLTVLHQDWLNGKEYKCKVSNKGLPSSIEKTISKAKGQPR

EPQVYTLPPSQEEMTKNQVSLTCLVKGFYPSDIAVEWESNGQPENNYKTTPPVLDSDGSFFLYSRLTVD

KSRWQEGNVFSCSVMHEALHNHYTQKSLSLSLGK

Light chain (SEQ ID NO: 228):
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGEC
```

-continued

Ly517
First polypeptide (from N→C terminus, heavy chain of Ly516 with IgG1
mutated Fc region and scFv of Ly253 in VL→VH orientation; SEQ ID NO:
229):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSDIQMTQSPSSVSAS

VGDRVTITCRASQGIYSWLAWYQQKPGKAPNLLIYTASTLQSGVPSRFSGSGSGTDFTLTISSLQPEDF

ATYYCQQANIFPLTFGGGTKVEIKGGGGSGGGGSGGGGSGGGGSQVQLVQSGAEVKKPGASVKVSCKAS

GYTFTGYYMHWVRQAPGQGLEWMGWINPDSGGTNYAQKFQGRVTMTRDTSISTAYMELNRLRSDDTAVY

YCARDQPLGYCTNGVCSYFDYWGQGTLVTVSS

Second polypeptide: light chain of Ly516 (SEQ ID NO: 228)

Ly518
First polypeptide (from N→C terminus, heavy chain of Ly516 with IgG1
mutated Fc region and scFv of Ly253 in VH→VL orientation; SEQ ID NO:
230):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGGSGGGGSGGGGSGGGGSQVQLVQSGAEVKKP

GASVKVSCKASGYTFTGYYMHWVRQAPGQGLEWMGWINPDSGGTNYAQKFQGRVTMTRDTSISTAYMEL

NRLRSDDTAVYYCARDQPLGYCTNGVCSYFDYWGQGTLVTVSSGGGGSGGGGSGGGGSGGGGSDIQMTQ

SPSSVSASVGDRVTITCRASQGIYSWLAWYQQKPGKAPNLLIYTASTLQSGVPSRFSGSGSGTDFTLTI

SSLQPEDFATYYCQQANIFPLTFGGGTKVEIK

Second polypeptide: light chain of Ly516 (SEQ ID NO:228)

Ly519
First polypeptide: heavy chain of Ly516 with IgG1 mutated Fc (SEQ
ID NO: 231):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

Second polypeptide (from N→C terminus, light chain of Ly516 and scFv
of Ly253 in VL→VH orientation; SEQ ID NO: 232):
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

-continued

FNRGECGGGGSGGGGSGGGGSGGGGSDIQMTQSPSSVSASVGDRVTITCRASQGIYSWLAWYQQKPGKA

PNLLIYTASTLQSGVPSRFSGSGSGTDFTLTISSLQPEDFATYYCQQANIFPLTFGGGTKVEIKGGGGS

GGGGSGGGGSGGGGSQVQLVQSGAEVKKPGASVKVSCKASGYTFTGYYMHWVRQAPGQGLEWMGWINPD

SGGTNYAQKFQGRVTMTRDTSISTAYMELNRLRSDDTAVYYCARDQPLGYCTNGVCSYFDYWGQGTLVT

VSS

Ly520
First polypeptide: heavy chain of Ly519 (SEQ ID NO: 231)
Second polypeptide (from N→C terminus, light chain of Ly516 and scFv
of Ly253 in VH→VL orientation; SEQ ID NO: 233):
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVQSGAEVKKPGASVKVSCKASGYTFTGYYMHWVRQAPGQ

GLEWMGWINPDSGGTNYAQKFQGRVTMTRDTSISTAYMELNRLRSDDTAVYYCARDQPLGYCTNGVCSY

FDYWGQGTLVTVSSGGGGSGGGGSGGGGSGGGGSDIQMTQSPSSVSASVGDRVTITCRASQGIYSWLAW

YQQKPGKAPNLLIYTASTLQSGVPSRFSGSGSGTDFTLTISSLQPEDFATYYCQQANIFPLTFGGGTKV

EIK

Ly606
First polypeptide (from N→C terminus, heavy chain of Ly516 with the
IgG1 mutated Fc region and scFv of TM740 in VL→VH orientation; SEQ
ID NO: 234):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSDIQMTQSPSSLSAS

VGDRVTITCKASQNIYIYLNWYQQKPGKAPKLLIYNTNNLQTGVPSRFSGSGSGTDFTLTISSLQPEDF

ATYYCLQHSSRRTFGGGTKVEIKGGGGSGGGGSGGGGSGGGGSQVQLVESGGGLVQPGGSLKLSCATSG

FNFNDYFMNWVRQASGKGLEWVGQIRNKNYNYATYYTESLEGRVTISRDDSKNTAYLQMNSLKTEDTAV

YYCTSYYYDGFADYFDYWGQGTTVTVSS

Second polypeptide: light chain of Ly516 (SEQ ID NO: 228)

Ly607
First polypeptide (from N→C terminus, heavy chain of Ly516 with the
IgG1 mutated Fc region and scFv of TM740 in VH→VL orientation; SEQ
ID NO: 235):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSQVQLVESGGGLVQP

GGSLKLSCATSGFNFNDYFMNWVRQASGKGLEWVGQIRNKNYNYATYYTESLEGRVTISRDDSKNTAYL

QMNSLKTEDTAVYYCTSYYYDGFADYFDYWGQGTTVTVSSGGGGSGGGGSGGGGSGGGGSDIQMTQSPS

SLSASVGDRVTITCKASQNIYIYLNWYQQKPGKAPKLLIYNTNNLQTGVPSRFSGSGSGTDFTLTISSL

QPEDFATYYCLQHSSRRTFGGGTKVEIK

Second polypeptide: light chain of Ly516 (SEQ ID NO: 228)

Ly817
First polypeptide: heavy chain of Ly519 (SEQ ID NO: 231)
Second polypeptide (from N→C terminus, light chain of Ly516 and scFv
of TM740 in VL→VH orientation; SEQ ID NO: 236):
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCKASQNIYIYLNWYQQKPGKA

PKLLIYNTNNLQTGVPSRFSGSGSGTDFTLTISSLQPEDFATYYCLQHSSRRTFGGGTKVEIKGGGGSG

GGGSGGGGSGGGGSQVQLVESGGGLVQPGGSLKLSCATSGFNFNDYFMNWVRQASGKGLEWVGQIRNKN

YNYATYYTESLEGRVTISRDDSKNTAYLQMNSLKTEDTAVYYCTSYYYDGFADYFDYWGQGTTVTVSS

Ly818
First polypeptide: heavy chain of Ly519 (SEQ ID NO: 231)
Second polypeptide (from N→C terminus, light chain of Ly516 and scFv
of TM740 in VH→VL orientation; SEQ ID NO: 237):
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSQVQLVESGGGLVQPGGSLKLSCATSGFNFNDYFMNWVRQASGK

GLEWVGQIRNKNYNYATYYTESLEGRVTISRDDSKNTAYLQMNSLKTEDTAVYYCTSYYYDGFADYFDY

WGQGTTVTVSSGGGGSGGGGSGGGGSGGGGSDIQMTQSPSSLSASVGDRVTITCKASQNIYIYLNWYQQ

KPGKAPKLLIYNTNNLQTGVPSRFSGSGSGTDFTLTISSLQPEDFATYYCLQHSSRRTFGGGTKVEIK

Ly608
First polypeptide (from N→C terminus, heavy chain of Ly516 with the
IgG1 mutated Fc region and scFv of TM559 in VL→VH orientation; SEQ ID
NO: 238):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSDIQMTQSPSSLSAS

VGDRVTITCLASEDISNDLAWYQQKPGKAPKLLIYFVDRLLDGVPSRFSGSGSGTDFTLTISSLQPEDF

ATYYCQQSYKYPPTFGQGTKLEIKGGGGSGGGGSGGGGSGGGGSEVQLVESGGGLVQPGGSLRLSCAAS

GFTFTNYGLHWVRQAPGKGLEWVSSISPSGGVTYYRDSVKGRFTISRDNSKNTLYLQMNSLRAEDTAVY

YCAKPFLGWGGANWIAHWGQGTLVTVSS

Second polypeptide: light chain of Ly516 (SEQ ID NO: 228)

Ly609
First polypeptide (from N→C terminus, heavy chain of Ly516 with the
IgG1 mutated Fc region and scFv of TM559 in VH→VL orientation; SEQ
ID NO: 239):
QVTLKESGPALVKPTQTLTLTCTFSGFSLSTSGTCVSWIRQPPGKALEWLATICWEDSKGYNPSLKSRL

TISKDTSKNQAVLTMTNMDPVDTATYYCARREDSGYFWFPYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVN

-continued

```
HKPSNTKVDKKVEPKSCDKTHTCPPCPAPELLGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGGGGSGGGGSGGGGSGGGGSEVQLVESGGGLVQP

GGSLRLSCAASGFTFTNYGLHWVRQAPGKGLEWVSSISPSGGVTYYRDSVKGRFTISRDNSKNTLYLQM

NSLRAEDTAVYYCAKPFLGWGGANWIAHWGQGTLVTVSSGGGGSGGGGSGGGGSGGGGSDIQMTQSPSS

LSASVGDRVTITCLASEDISNDLAWYQQKPGKAPKLLIYFVDRLLDGVPSRFSGSGSGTDFTLTISSLQ

PEDFATYYCQQSYKYPPTFGQGTKLEIK
```

Second polypeptide: light chain of Ly516 (SEQ ID NO: 228)

Ly819
First polypeptide: heavy chain of Ly519 (SEQ ID NO: 231)
Second polypeptide (from NC terminus, light chain of Ly516 and scFv
of TM559 in VL→VH orientation; SEQ ID NO: 240):
```
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSDIQMTQSPSSLSASVGDRVTITCLASEDISNDLAWYQQKPGKA

PKLLIYFVDRLLDGVPSRFSGSGSGTDFTLTISSLQPEDFATYYCQQSYKYPPTFGQGTKLEIKGGGGS

GGGGSGGGGSGGGGSEVQLVESGGGLVQPGGSLRLSCAASGFTFTNYGLHWVRQAPGKGLEWVSSISPS

GGVTYYRDSVKGRFTISRDNSKNTLYLQMNSLRAEDTAVYYCAKPFLGWGGANWIAHWGQGTLVTVSS
```

Ly820
First polypeptide: heavy chain of Ly519 (SEQ ID NO: 231)
Second polypeptide (from N→C terminus, light chain of Ly516 and scFv
of TM559 in VH→VL orientation; SEQ ID NO: 241):
```
NIQMTQSPSSLSASVGDRVTITCKAGQNVNNYLAWYQQKPGKAPKVLIFNANSLQTGVPSRFSGSGSGT

DFTLTISSLQPEDFATYYCQQYNSWPTFGGGTKVEIKRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKS

FNRGECGGGGSGGGGSGGGGSGGGGSEVQLVESGGGLVQPGGSLRLSCAASGFTFTNYGLHWVRQAPGK

GLEWVSSISPSGGVTYYRDSVKGRFTISRDNSKNTLYLQMNSLRAEDTAVYYCAKPFLGWGGANWIAHW

GQGTLVTVSSGGGGSGGGGSGGGGSGGGGSDIQMTQSPSSLSASVGDRVTITCLASEDISNDLAWYQQK

PGKAPKLLIYFVDRLLDGVPSRFSGSGSGTDFTLTISSLQPEDFATYYCQQSYKYPPTFGQGTKLEIK
```

In some embodiments, the anti-PD-1/anti-CD40 bispecific antibodies disclosed herein comprise a first polypeptide, which is a fusion polypeptide comprising the anti-CD40 portion in scFv format and the heavy chain of the anti-PD-1 portion. In some examples, the anti-CD40 scFv may be in VH→VL orientation. Alternatively, the anti-CD40 scFv may be in VL→VH orientation. In some examples, the heavy chain of the anti-PD-1 portion may be located at the N-terminal of the first polypeptide. In other instances, the anti-CD40 scFv portion may be located at the N-terminal of the first polypeptide. The anti-PD-1/anti-CD40 bispecific antibodies in this format (e.g., Ly517 and Ly518) were found to exhibit unexpected superior features, for example, superior anti-tumor activities with no apparent liver toxicity as shown herein, for example, the data provided below.

Characterization of Anti-PD-1/CD40 Bi-Specific Antibodies (i) Binding Activity

Anti-PD-1/CD40 bi-specific antibodies were analyzed by FACS for their binding properties to human PD-1 and/or human CD40 expressed on CHO cells. Briefly, cultured cells were harvested, counted and cell viability was evaluated using the Trypan Blue exclusion method. Viable cells were then adjusted to $2 \times 10^6$ cells per mL in PBS containing 2% BSA. 100 μL of this cell suspension were further aliquoted per well into a V-bottom 96-well plate. 50 μL of the bi-specific antibodies or corresponding IgG control were added to the cell-containing wells to obtain final concentrations of 0.1 μg/mL to 10 μg/mL. After incubation for 2 hours at 4° C., cells were centrifuged (3 min, 1000×g), washed with 250 μL/well BSA-containing FACS Stain Buffer, resuspended and incubated for an additional 1 hour at 4° C. with 100 μL/well fluorochrome-conjugated anti-IgG antibody for detection of the bispecific antibody. Cells were then washed with 250 μL/well BSA-containing FACS Stain Buffer, resuspended in 100 μL/well FACS Stain Buffer, acquired and analyzed using a FACS machine. Binding of the bispecific antibodies to human PD-1 or human CD40 expressing CHO cells were evaluated and the mean fluorescence intensity is plotted in histograms or dot plots.

As shown in FIGS. 40A and 40B, the exemplary anti-PD-1/CD40 bi-specific antibodies exhibited similar binding affinity to human PD-1 expressed on the CHO cells overexpressing such as SSI361. As shown in FIGS. 41A and 41B, the bi-specific antibodies exhibited binding affinity to human CD40 expressed on CHO cells. Compared to the corresponding parental antibody, the binding activity of bi-specific antibodies comprising scFv formats of the CD40 antibodies remain minimally changed.

Anti-PD-1/CD40 bi-specific antibodies were analyzed by ELISA for their simultaneous binding to recombinant human PD-1 and human CD40. Briefly, human CD40 ECD protein (His tag) was diluted and coated onto an ELISA plate with a volume of 100/well by incubation at 4° C. overnight. The next day, the plate was blocked with PBST-BSA buffer, then serially diluted samples of anti-PD-1/CD40 bi-specific anti-bodies were pipetted into appropriate wells at 50 μL/well, and the plate was incubated for 1 h followed by washing. Human PD-1-ECD protein (mouse IgG2a Fc tag) was added into the plate at 50 μL/well. After 1-hour incubation at room temperature, HRP-conjugated anti-Mouse IgG (H+L) anti-body was added into the plate at 100 μL/well. The plate was incubated for 1 hour at room temperature followed by washing. TMB substrate solution was added at 100 μL/well and the color development was stopped by adding 100 μL/well Stop Solution (2N $H_2SO_4$). Absorbance at 450 nm and 620 nm was read by Tecan F200 Pro plate reader. GraphPad 7.0, "[Agonist] vs. response—Variable slope (four parameters)" was used to plot the binding data and calculate binding EC50 values.

As shown in FIGS. 42A-42H, the exemplary anti-PD-1/CD40 bi-specific antibodies simultaneously binded to coated recombinant human CD40 and soluble human recom-binant PD-1.

(ii) Agonistic Activity for CD40

The CD40 reporter assay disclosed herein was used to determine the agonist activity of the bispecific antibodies, following the same procedures disclosed in Example 2 above. The CD40 reporter assay was also performed in co-culture with PD-1-expressing CHO cells. As shown in FIGS. 43A-43D, the bi-specific antibodies in solution showed a various degree of CD40 agonist activity. The agonist activity was greatly enhanced in the co-culture assay, as indicated by the saturation of dose response where lowest concentration of 0.01 μg/mL bispecific antibodies exhibited maximal activity. Binding to both CD40 and PD-1 by the tested bi-specific antibodies simultaneously in a microenvi-ronment would affect individual binding due to the avidity effect, which refers to the accumulated strength of multiple affinities of individual non-covalent binding interactions. The bi-specific antibodies showed increased activity when co-cultured with PD-1-expressing CHO cells. Therefore, binding profile to human PD-1 and CD40 would affect the agonist activity of these bi-specific antibodies.

(iii) Blockage of PD-1/PD-L1 Interaction

The PD-1 reporter assay disclosed herein was used to determine the ability of the bi-specific antibodies in blocking PD-L1/PD-1 cellular function, following the same proce-dures disclosed in Example 3 above. The anti-PD-1 and CD40 antibodies were used as reference.

As shown in FIGS. 44A-44B, the bi-specific antibodies showed stronger blocking activity than the PD-1 or CD40 antibody.

(iv) B Cell Proliferation

Exemplary anti-PD-1/anti-CD40 bispecific antibodies were evaluated for the activity to stimulate the proliferation of human B cells following the procedures disclosed in Example 3 above. As shown in FIGS. 44A-44B, these bi-specific antibodies exhibited distinct profile on the pro-liferation of B cells.

(v) Pharmacokinetic Studies of Exemplary Anti-PD-1/Anti-CD40 Bi-Specific Antibodies C57BL/6 mice (6-7 weeks old, 19-20 g, male, purchased from SLAC Laboratory Animal Co. LTD) were used for the study. Antibodies were formulated in PBS and administered via tail vein injection at 3 mg/kg in a group of 4 mice.

Blood sampling was done at pre-dose, 1d, 4d, 7d, 10d, 14d, 17d and 21d by serial bleeding. 10 μL blood per time point was added to 40 μL of a PBS-BSA solution. The sample was then mixed well and centrifuged at 2000 g for 5 minutes at 4° C. The supernatant was put on dry ice immediately after collection and stored at approximately −70° C. until analysis. Blood antibody concentrations were determined by ELISA. FIGS. 46A-46H showed the blood concentrations of the bispecific antibodies after a single intravenous injection of 5 mg/kg. These bispecific antibod-ies showed high and lasting circulation concentrations.

(vi) Anti-Tumor Activity

Exemplary anti-PD-1/CD40 antibodies were tested in mouse syngeneic tumor models in vivo to determine the anti-tumor efficacy and toxicity of these antibodies. Oval-bumin overexpressing murine melanoma B16F10 tumor cells were subcutaneously implanted into homozygous human CD40 knock-in C57BL6 mice. Mice were grouped when the tumor size was approximately $150\pm50$ mm$^3$ (n=6). Anti-PD-L1/CD40 antibodies were administered by intrap-eritoneal injections and tumor sizes were measure during 4-6 weeks of antibody treatment. Tumor sizes were calculated as tumor volume using formula of $0.5\times length\times width^2$.

Anti-tumor efficacy was evaluated between tumor sizes of the control group and antibody treatment group as shown in FIG. 47. Antibody Keytruda and CD40 ref mAb were used reference. It is of interest to note that, even though Keytruda didn't show anti-tumor activity in the experiment shown in FIG. 47, Clone Ly517 still showed comparable efficacy relative to Ly253-G2. Furthermore, Ly517 and Ly607 did not cause apparent elevation of serum ALT (FIG. 48).

Example 9: Anti-HER2/CD40 Bi-Specific Antibodies

HER2 represents a typical oncogenic growth receptor that is highly expressed in tumors. Monoclonal antibodies tar-geting HER2 has been marketed for cancer treatment. Anti-HER2/CD40 bi-specific antibodies were produced using the human or humanized anti-CD40 antibodies exemplified above. cDNAs encoding VH and VL chains of anti-HER2 antibodies and those of anti-CD40 antibodies were used as the starting materials. CHO-cell transient expression was carried out using plasmids configured for expressing poly-peptide chains of the bi-specific antibodies. These antibodies were purified by protein A affinity chromatography.

The amino acid sequences of the heavy chain (HC) and the light chain (LC) of the anti-HER2 antibodies (TM737 and Ly591) and of the polypeptides of the bi-specific anti-bodies are provided below:

TM737
Heavy chain (SEQ ID NO: 242):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

Light chain (SEQ ID NO: 243):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGEC

Ly591
Heavy chain (SEQ ID NO: 244):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGK

Light chain (SEQ ID NO: 245):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGEC

Ly618
First polypeptide (from N→C terminus, heavy chain of TM737 with IgG1
mutated Fc region and scFv of TM740 in VL→VH orientation; SEQ ID NO:
246):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSDIQMTQSPSSLSASV

GDRVTITCKASQNIYIYLNWYQQKPGKAPKLLIYNTNNLQTGVPSRFSGSGSGTDFTLTISSLQPEDFA

TYYCLQHSSRRTFGGGTKVEIKGGGGSGGGGSGGGGSGGGGSQVQLVESGGGLVQPGGSLKLSCATSGF

NFNDYFMNWVRQASGKGLEWVGQIRNKNYNYATYYTESLEGRVTISRDDSKNTAYLQMNSLKTEDTAVY

YCTSYYYDGFADYFDYWGQGTTVTVSS

-continued

Second polypeptide: light chain of TM737 (SEQ ID NO: 243)

Ly619
First polypeptide (from N→C terminus, heavy chain of TM737 with IgG1
mutated Fc region and scFv of TM740 in VH→VL orientation; SEQ ID NO:
247):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSQVQLVESGGGLVQPG

GSLKLSCATSGFNFNDYFMNWVRQASGKGLEWVGQIRNKNYNYATYYTESLEGRVTISRDDSKNTAYLQ

MNSLKTEDTAVYYCTSYYYDGFADYFDYWGQGTTVTVSSGGGGSGGGGSGGGGSGGGGSDIQMTQSPSS

LSASVGDRVTITCKASQNIYIYLNWYQQKPGKAPKLLIYNTNNLQTGVPSRFSGSGSGTDFTLTISSLQ

PEDFATYYCLQHSSRRTFGGGTKVEIK

Second polypeptide: light chain of TM737 (SEQ ID NO: 243)

Ly821
First polypeptide: heavy chain of TM737 with IgG1 mutated Fc (SEQ ID
NO: 248):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPG

Second polypeptide (from N→C terminus, light chain of TM737 and scFv
of TM740 in VL→VH orientation; SEQ ID NO: 249):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSLSASVGDRVTITCKASQNIYIYLNWYQQKPGK

APKLLIYNTNNLQTGVPSRFSGSGSGTDFTLTISSLQPEDFATYYCLQHSSRRTFGGGTKVEIKGGGGS

GGGGSGGGGSGGGGSQVQLVESGGGLVQPGGSLKLSCATSGFNFNDYFMNWVRQASGKGLEWVGQIRNK

NYNYATYYTESLEGRVTISRDDSKNTAYLQMNSLKTEDTAVYYCTSYYYDGFADYFDYWGQGTTVTVSS

Ly822
First polypeptide: heavy chain of Ly821 (SEQ ID NO: 248)
Second polypeptide (from N→C terminus, light chain of TM737 and scFv
of TM740 in VH→VL orientation; SEQ ID NO: 250):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSQVQLVESGGGLVQPGGSLKLSCATSGFNFNDYFMNWVRQASG

KGLEWVGQIRNKNYNYATYYTESLEGRVTISRDDSKNTAYLQMNSLKTEDTAVYYCTSYYYDGFADYFD

YWGQGTTVTVSSGGGGSGGGGSGGGGSGGGGSDIQMTQSPSSLSASVGDRVTITCKASQNIYIYLNWYQ

QKPGKAPKLLIYNTNNLQTGVPSRFSGSGSGTDFTLTISSLQPEDFATYYCLQHSSRRTFGGGTKVEIK

Ly620
First polypeptide (from N→C terminus, heavy chain of TM737 with IgG1
mutated Fc region and scFv of TM599 in VL→VH orientation; SEQ ID NO:
251):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSDIQMTQSPSSLSASV

GDRVTITCLASEDISNDLAWYQQKPGKAPKLLIYFVDRLLDGVPSRFSGSGSGTDFTLTISSLQPEDFA

TYYCQQSYKYPPTFGQGTKLEIKGGGGSGGGGSGGGGSGGGGSEVQLVESGGGLVQPGGSLRLSCAASG

FTFTNYGLHWVRQAPGKGLEWVSSISPSGGVTYYRDSVKGRFTISRDNSKNTLYLQMNSLRAEDTAVYY

CAKPFLGWGGANWIAHWGQGTLVTVSS

Second polypeptide: light chain of TM737 (SEQ ID NO: 243)

Ly621
First polypeptide (from N→C terminus, heavy chain of TM737 with IgG1
mutated Fc region and scFv of TM559 in VH→VL orientation; SEQ ID NO:
252):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSEVQLVESGGGLVQPG

GSLRLSCAASGFTFTNYGLHWVRQAPGKGLEWVSSISPSGGVTYYRDSVKGRFTISRDNSKNTLYLQMN

SLRAEDTAVYYCAKPFLGWGGANWIAHWGQGTLVTVSSGGGGSGGGGSGGGGSGGGGSDIQMTQSPSSL

SASVGDRVTITCLASEDISNDLAWYQQKPGKAPKLLIYFVDRLLDGVPSRFSGSGSGTDFTLTISSLQP

EDFATYYCQQSYKYPPTFGQGTKLEIK

Second polypeptide: light chain of TM737 (SEQ ID NO: 243)

Ly823
First polypeptide: heavy chain of Ly821 (SEQ ID NO: 248)
Second polypeptide (from N→C terminus, light chain of TM737 and scFv
of TM559 in VL→VH orientation; SEQ ID NO: 253):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSLSASVGDRVTITCLASEDISNDLAWYQQKPGK

APKLLIYFVDRLLDGVPSRFSGSGSGTDFTLTISSLQPEDFATYYCQQSYKYPPTFGQGTKLEIKGGGG

SGGGGSGGGGSGGGGSEVQLVESGGGLVQPGGSLRLSCAASGFTFTNYGLHWVRQAPGKGLEWVSSISP

SGGVTYYRDSVKGRFTISRDNSKNTLYLQMNSLRAEDTAVYYCAKPFLGWGGANWIAHWGQGTLVTVSS

-continued

Ly824
First polypeptide: heavy chain of Ly821 (SEQ ID NO: 248)
Second polypeptide (from N→C terminus, light chain of TM737 and scFv
of TM559 in VH→VL orientation; SEQ ID NO: 254):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSEVQLVESGGGLVQPGGSLRLSCAASGFTFTNYGLHWVRQAPG

KGLEWVSSISPSGGVTYYRDSVKGRFTISRDNSKNTLYLQMNSLRAEDTAVYYCAKPFLGWGGANWIAH

WGQGTLVTVSSGGGGSGGGGSGGGGSGGGGSDIQMTQSPSSLSASVGDRVTITCLASEDISNDLAWYQQ

KPGKAPKLLIYFVDRLLDGVPSRFSGSGSGTDFTLTISSLQPEDFATYCQQSYKYPPTFGQGTKLEIK

Ly622
First polypeptide (from N→C terminus, heavy chain of Ly591 with IgG1
mutated Fc region and scFv of TM740 in VL→VH orientation; SEQ ID NO:
255):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSLSASVG

DRVTITCKASQNIYIYLNWYQQKPGKAPKLLIYNTNNLQTGVPSRFSGSGSGTDFTLTISSLQPEDFAT

YYCLQHSSRRTFGGGTKVEIKGGGGSGGGGSGGGGSGGGGSQVQLVESGGGLVQPGGSLKLSCATSGFN

FNDYFMNWVRQASGKGLEWVGQIRNKNYNYATYYTESLEGRVTISRDDSKNTAYLQMNSLKTEDTAVYY

CTSYYYDGFADYFDYWGQGTTVTVSS

Second polypeptide: light chain of Ly591 (SEQ ID NO: 245)

Ly623
First polypeptide (from N→C terminus, heavy chain of Ly591 with IgG1
mutated Fc region and scFv of TM740 in VH→VL orientation; SEQ ID NO:
256):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSQVQLVESGGGLVQPGG

SLKLSCATSGFNFNDYFMNWVRQASGKGLEWVGQIRNKNYNYATYYTESLEGRVTISRDDSKNTAYLQM

NSLKTEDTAVYYCTSYYYDGFADYFDYWGQGTTVTVSSGGGGSGGGGSGGGGSGGGGSDIQMTQSPSSL

SASVGDRVTITCKASQNIYIYLNWYQQKPGKAPKLLIYNTNNLQTGVPSRFSGSGSGTDFTLTISSLQP

EDFATYYCLQHSSRRTFGGGTKVEIK

Second polypeptide: light chain of Ly591 (SEQ ID NO: 245)

Ly825
First polypeptide: heavy chain of Ly591 with IgG1 mutated Fc (SEQ ID
NO: 257):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

-continued

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPG

Second polypeptide (from N→C terminus, light chain of Ly591 and scFv
of TM740 in VL→VH orientation; SEQ ID NO: 258):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSLSASVGDRVTITCKASQNIYIYLNWYQQKPGK

APKLLIYNTNNLQTGVPSRFSGSGSGTDFTLTISSLQPEDFATYYCLQHSSRRTFGGGTKVEIKGGGGS

GGGGSGGGGSGGGGSQVQLVESGGGLVQPGGSLKLSCATSGFNFNDYFMNWVRQASGKGLEWVGQIRNK

NYNYATYYTESLEGRVTISRDDSKNTAYLQMNSLKTEDTAVYYCTSYYYDGFADYFDYWGQGTTVTVSS

Ly826
First polypeptide: heavy chain of Ly825 (SEQ ID NO: 257)
Second polypeptide (from N→C terminus, light chain of Ly591 and scFv
of TM740 in VH→VL orientation; SEQ ID NO: 259):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSQVQLVESGGGLVQPGGSLKLSCATSGFNFNDYFMNWVRQASG

KGLEWVGQIRNKNYNYATYYTESLEGRVTISRDDSKNTAYLQMNSLKTEDTAVYYCTSYYYDGFADYFD

YWGQGTTVTVSSGGGGSGGGGSGGGGSGGGGSDIQMTQSPSSLSASVGDRVTITCKASQNIYIYLNWYQ

QKPGKAPKLLIYNTNNLQTGVPSRFSGSGSGTDFTLTISSLQPEDFATYYCLQHSSRRTFGGGTKVEIK

Ly624
First polypeptide (from N→C terminus, heavy chain of Ly591 with IgG1
mutated Fc region and scFv of TM599 in VL→VH orientation; SEQ ID NO:
260):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSLSASVG

DRVTITCLASEDISNDLAWYQQKPGKAPKLLIYFVDRLLDGVPSRFSGSGSGTDFTLTISSLQPEDFAT

YYCQQSYKYPPTFGQGTKLEIKGGGGSGGGGSGGGGSGGGGSEVQLVESGGGLVQPGGSLRLSCAASGF

TFTNYGLHWVRQAPGKGLEWVSSISPSGGVTYYRDSVKGRFTISRDNSKNTLYLQMNSLRAEDTAVYYC

AKPFLGWGGANWIAHWGQGTLVTVSS

Second polypeptide: light chain of Ly591 (SEQ ID NO: 245)

Ly625
First polypeptide (from N→C terminus, heavy chain of Ly591 with IgG1
mutated Fc region and scFv of TM599 in VH→VL orientation; SEQ ID NO:
261):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

-continued

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGSGGGGSGGGGSGGGGSEVQLVESGGGLVQPGG

SLRLSCAASGFTFTNYGLHWVRQAPGKGLEWVSSISPSGGVTYYRDSVKGRFTISRDNSKNTLYLQMNS

LRAEDTAVYYCAKPFLGWGGANWIAHWGQGTLVTVSSGGGGSGGGGSGGGGSGGGGSDIQMTQSPSSLS

ASVGDRVTITCLASEDISNDLAWYQQKPGKAPKLLIYFVDRLLDGVPSRFSGSGSGTDFTLTISSLQPE

DFATYYCQQSYKYPPTFGQGTKLEIK

Second polypeptide: light chain of Ly591 (SEQ ID NO: 245)

Ly827
First polypeptide: heavy chain of Ly825 (SEQ ID NO: 257)
Second polypeptide (from N→C terminus, light chain of Ly591 and scFv
of TM559 in VL→VH orientation; SEQ ID NO: 262):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSLSASVGDRVTITCLASEDISNDLAWYQQKPGK

APKLLIYFVDRLLDGVPSRFSGSGSGTDFTLTISSLQPEDFATYYCQQSYKYPPTFGQGTKLEIKGGGG

SGGGGSGGGGSGGGGSEVQLVESGGGLVQPGGSLRLSCAASGFTFTNYGLHWVRQAPGKGLEWVSSISP

SGGVTYYRDSVKGRFTISRDNSKNTLYLQMNSLRAEDTAVYYCAKPFLGWGGANWIAHWGQGTLVTVSS

Ly828
First polypeptide: heavy chain of Ly825 (SEQ ID NO: 257)
Second polypeptide (from N→C terminus, light chain of Ly591 and scFv
of TM559 in VH→VL orientation; SEQ ID NO: 263):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSEVQLVESGGGLVQPGGSLRLSCAASGFTFTNYGLHWVRQAPG

KGLEWVSSISPSGGVTYYRDSVKGRFTISRDNSKNTLYLQMNSLRAEDTAVYYCAKPFLGWGGANWIAH

WGQGTLVTVSSGGGGSGGGGSGGGGSGGGGSDIQMTQSPSSLSASVGDRVTITCLASEDISNDLAWYQQ

KPGKAPKLLIYFVDRLLDGVPSRFSGSGSGTDFTLTISSLQPEDFATYYCQQSYKYPPTFGQGTKLEIK

Ly829
First polypeptide (from N→C terminus, heavy chain of TM737 with IgG1
mutated Fc region and scFv of Ly253 in VL→VH orientation; SEQ ID NO:
264):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGSGGGGSGGGGSGGGGSDIQMTQSPSSVSASV

GDRVTITCRASQGIYSWLAWYQQKPGKAPNLLIYTASTLQSGVPSRFSGSGSGTDFTLTISSLQPEDFA

TYYCQQANIFPLTFGGGTKVEIKGGGGSGGGGSGGGGSGGGGSQVQLVQSGAEVKKPGASVKVSCKASG

YTFTGYYMHWVRQAPGQGLEWMGWINPDSGGTNYAQKFQGRVTMTRDTSISTAYMELNRLRSDDTAVYY

CARDQPLGYCTNGVCSYFDYWGQGTLVTVSS

-continued

Second polypeptide: light chain of TM737 (SEQ ID NO: 243)

Ly830
First polypeptide (from N→C terminus, heavy chain of TM737 with IgG1
mutated Fc region and scFv of Ly253 in VH→VL orientation; SEQ ID NO:
265):
EVQLVESGGGLVQPGGSLRLSCAASGFNIKDTYIHWVRQAPGKGLEWVARIYPTNGYTRYADSVKGRFT

ISADTSKNTAYLQMNSLRAEDTAVYYCSRWGGDGFYAMDYWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGGGGGSGGGGSGGGGSGGGGSQVQLVQSGAEVKKPG

ASVKVSCKASGYTFTGYYMHWVRQAPGQGLEWMGWINPDSGGTNYAQKFQGRVTMTRDTSISTAYMELN

RLRSDDTAVYYCARDQPLGYCTNGVCSYFDYWGQGTLVTVSSGGGGSGGGGSGGGGSGGGGSDIQMTQS

PSSVSASVGDRVTITCRASQGIYSWLAWYQQKPGKAPNLLIYTASTLQSGVPSRFSGSGSGTDFTLTIS

SLQPEDFATYYCQQANIFPLTFGGGTKVEIK

Second polypeptide: light chain of TM737 (SEQ ID NO: 243)

Ly831
First polypeptide: heavy chain of Ly821 (SEQ ID NO: 248)
Second polypeptide (from N→C terminus, light chain of TM737 and scFv
of Ly253 in VL→VH orientation; SEQ ID NO: 266):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSVSASVGDRVTITCRASQGIYSWLAWYQQKPGK

APNLLIYTASTLQSGVPSRFSGSGSGTDFTLTISSLQPEDFATYYCQQANIFPLTFGGGTKVEIKGGGG

SGGGGSGGGGSGGGGSQVQLVQSGAEVKKPGASVKVSCKASGYTFTGYYMHWVRQAPGQGLEWMGWINP

DSGGTNYAQKFQGRVTMTRDTSISTAYMELNRLRSDDTAVYYCARDQPLGYCTNGVCSYFDYWGQGTLV

TVSS

Ly832
First polypeptide: heavy chain of Ly821 (SEQ ID NO: 248)
Second polypeptide (from N→C terminus, light chain of TM737 and scFv
of Ly253 in VH→VL orientation; SEQ ID NO: 267):
DIQMTQSPSSLSASVGDRVTITCRASQDVNTAVAWYQQKPGKAPKLLIYSASFLYSGVPSRFSGSRSGT

DFTLTISSLQPEDFATYYCQQHYTTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSQVQLVQSGAEVKKPGASVKVSCKASGYTFTGYYMHWVRQAPG

QGLEWMGWINPDSGGTNYAQKFQGRVTMTRDTSISTAYMELNRLRSDDTAVYYCARDQPLGYCTNGVCS

YFDYWGQGTLVTVSSGGGGSGGGGSGGGGSGGGGSDIQMTQSPSSVSASVGDRVTITCRASQGIYSWLA

WYQQKPGKAPNLLIYTASTLQSGVPSRFSGSGSGTDFTLTISSLQPEDFATYYCQQANIFPLTFGGGTK

VEIK

Ly833
First polypeptide (from N→C terminus, heavy chain of Ly591 with IgG1
mutated Fc region and scFv of Ly253 in VL→VH orientation; SEQ ID NO:
268):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSDIQMTQSPSSVSASVG

DRVTITCRASQGIYSWLAWYQQKPGKAPNLLIYTASTLQSGVPSRFSGSGSGTDFTLTISSLQPEDFAT

YYCQQANIFPLTFGGGTKVEIKGGGGSGGGGSGGGGSGGGGSQVQLVQSGAEVKKPGASVKVSCKASGY

TFTGYYMHWVRQAPGQGLEWMGWINPDSGGTNYAQKFQGRVTMTRDTSISTAYMELNRLRSDDTAVYYC

ARDQPLGYCTNGVCSYFDYWGQGTLVTVSS

Second polypeptide: light chain of Ly591 (SEQ ID NO: 245)

Ly834
First polypeptide (from N→C terminus, heavy chain of Ly591 with IgG1
mutated Fc region and scFv of Ly253 in VH→VL orientation; SEQ ID NO:
269):
EVQLVESGGGLVQPGGSLRLSCAASGFTFTDYTMDWVRQAPGKGLEWVADVNPNSGGSIYNQRFKGRFT

LSVDRSKNTLYLQMNSLRAEDTAVYYCARNLGPSFYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHK

PSNTKVDKKVEPKSCDKTHTCPPCPAPELLGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGGGGGSGGGGSGGGGSGGGGSQVQLVQSGAEVKKPGA

SVKVSCKASGYTFTGYYMHWVRQAPGQGLEWMGWINPDSGGTNYAQKFQGRVTMTRDTSISTAYMELNR

LRSDDTAVYYCARDQPLGYCTNGVCSYFDYWGQGTLVTVSSGGGGSGGGGSGGGGSGGGGSDIQMTQSP

SSVSASVGDRVTITCRASQGIYSWLAWYQQKPGKAPNLLIYTASTLQSGVPSRFSGSGSGTDFTLTISS

LQPEDFATYYCQQANIFPLTFGGGTKVEIK

Second polypeptide: light chain of Ly591 (SEQ ID NO: 245)

Ly835
First polypeptide: heavy chain of Ly825 (SEQ ID NO: 257)
Second polypeptide (from N→C terminus, light chain of Ly591 and scFv
of Ly253 in VL→VH orientation; SEQ ID NO: 270):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSDIQMTQSPSSVSASVGDRVTITCRASQGIYSWLAWYQQKPGK

APNLLIYTASTLQSGVPSRFSGSGSGTDFTLTISSLQPEDFATYYCQQANIFPLTFGGGTKVEIKGGGG

SGGGGSGGGGSGGGGSQVQLVQSGAEVKKPGASVKVSCKASGYTFTGYYMHWVRQAPGQGLEWMGWINP

DSGGTNYAQKFQGRVTMTRDTSISTAYMELNRLRSDDTAVYYCARDQPLGYCTNGVCSYFDYWGQGTLV

TVSS

Ly836
First polypeptide: heavy chain of Ly825 (SEQ ID NO: 257)
Second polypeptide (from N→C terminus, light chain of Ly591 and scFv
of Ly253 in VH→VL orientation; SEQ ID NO: 271):
DIQMTQSPSSLSASVGDRVTITCKASQDVSIGVAWYQQKPGKAPKLLIYSASYRYTGVPSRFSGSGSGT

DFTLTISSLQPEDFATYYCQQYYIYPYTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTK

SFNRGECGGGGSGGGGSGGGGSGGGGSQVQLVQSGAEVKKPGASVKVSCKASGYTFTGYYMHWVRQAPG

QGLEWMGWINPDSGGTNYAQKFQGRVTMTRDTSISTAYMELNRLRSDDTAVYYCARDQPLGYCTNGVCS

YFDYWGQGTLVTVSSGGGGSGGGGSGGGGSGGGGSDIQMTQSPSSVSASVGDRVTITCRASQGIYSWLA

-continued

WYQQKPGKAPNLLIYTASTLQSGVPSRFSGSGSGTDFTLTISSLQPEDFATYYCQQANIFPLTFGGGTK

VEIK

These bispecific antibodies are to be evaluated for their in vitro and in vivo activity, including binding to target antigen (HER2 and CD40), agonistic activity in a CD40 reporter assay system, activation of B cell and DC cell, anti-tumor activity in mouse models.

Characterization of Anti-HER2/CD40 Bi-Specific Antibodies (i) Binding Activity

Anti-HER2/CD40 bi-specific antibodies were analyzed by FACS for their binding properties to human HER2 and/or human CD40 expressed on CHO cells. Briefly, cultured cells were harvested, counted and cell viability was evaluated using the Trypan Blue exclusion method. Viable cells were then adjusted to $2 \times 10^6$ cells per mL in PBS containing 2% BSA. 100 µL of this cell suspension were further aliquoted per well into a V-bottom 96-well plate. 50 µL of the bi-specific antibodies or corresponding IgG control were added to the cell-containing wells to obtain final concentrations of 0.1 µg/mL to 10 g/mL. After incubation for 2 hours at 4° C., cells were centrifuged (3 min, 1000×g), washed with 250 µL/well BSA-containing FACS Stain Buffer, resuspended and incubated for an additional 1 hour at 4° C. with 100 µL/well fluorochrome-conjugated anti-IgG antibody for detection of the bispecific antibody. Cells were then washed with 250 µL/well BSA-containing FACS Stain Buffer, resuspended in 100 µL/well FACS Stain Buffer, acquired and analyzed using a FACS machine. Binding of the bispecific antibodies to human HER2 or human CD40 expressing CHO cells were evaluated and the mean fluorescence intensity is plotted in histograms or dot plots.

As shown in FIGS. 49A-49C, the exemplary anti-HER2/CD40 bi-specific antibodies exhibited similar binding affinity to human HER2 expressed on the CHO cells overexpressing HER2. As shown in FIGS. 50A-50C, the bi-specific antibodies exhibited binding affinity to human CD40 expressed on CHO cells. Compared to the corresponding parental antibody, the binding activity of bi-specific antibodies comprising scFv formats of the CD40 antibodies remain minimally changed.

(ii) Agonistic Activity for CD40

The CD40 reporter assay disclosed herein was used to determine the agonist activity of the bispecific antibodies, following the same procedures disclosed in Example 2 above. The CD40 reporter assay was also performed in co-culture with HER2-expressing CHO cells.

As shown in FIG. 51, panels A-F, the bi-specific antibodies in solution showed a various degree of CD40 agonist activity. Binding to both CD40 and HER2 by the tested bi-specific antibodies simultaneously in a microenvironment would affect individual binding due to the avidity effect, which refers to the accumulated strength of multiple affinities of individual non-covalent binding interactions. The bi-specific antibodies showed increased activity when co-cultured with HER2-expressing CHO cells. Therefore, binding profile to human HER2 and CD40 would affect the agonist activity of these bi-specific antibodies.

(iii) B Cell Proliferation

Figure 52A:
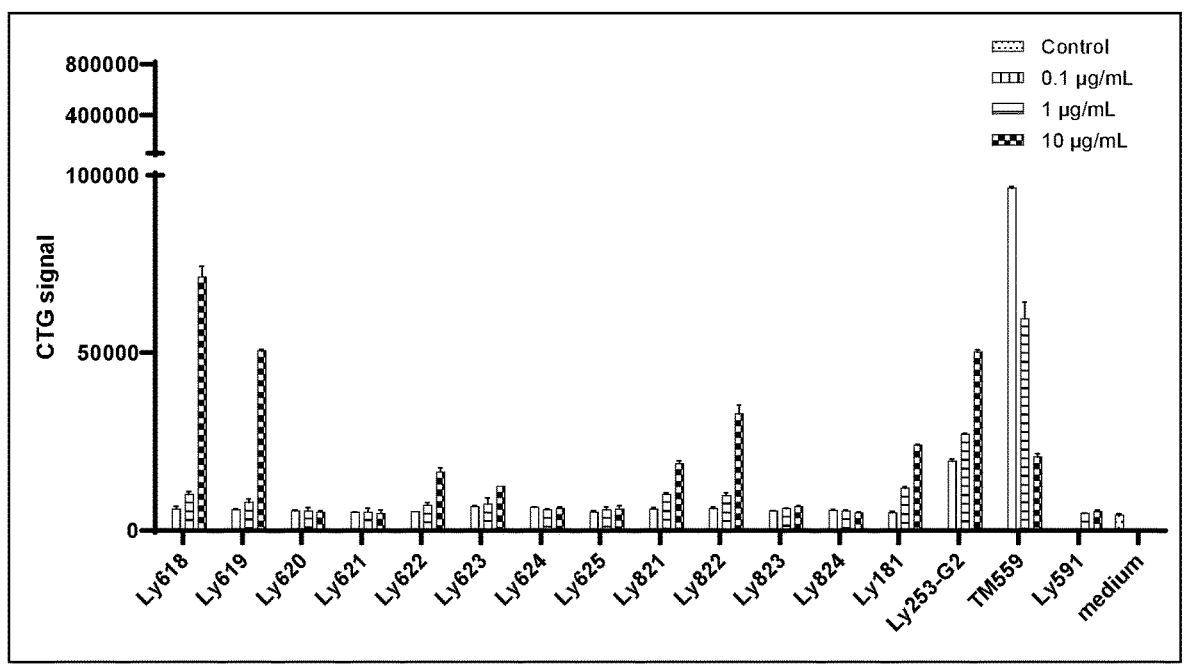
Figure 52B:
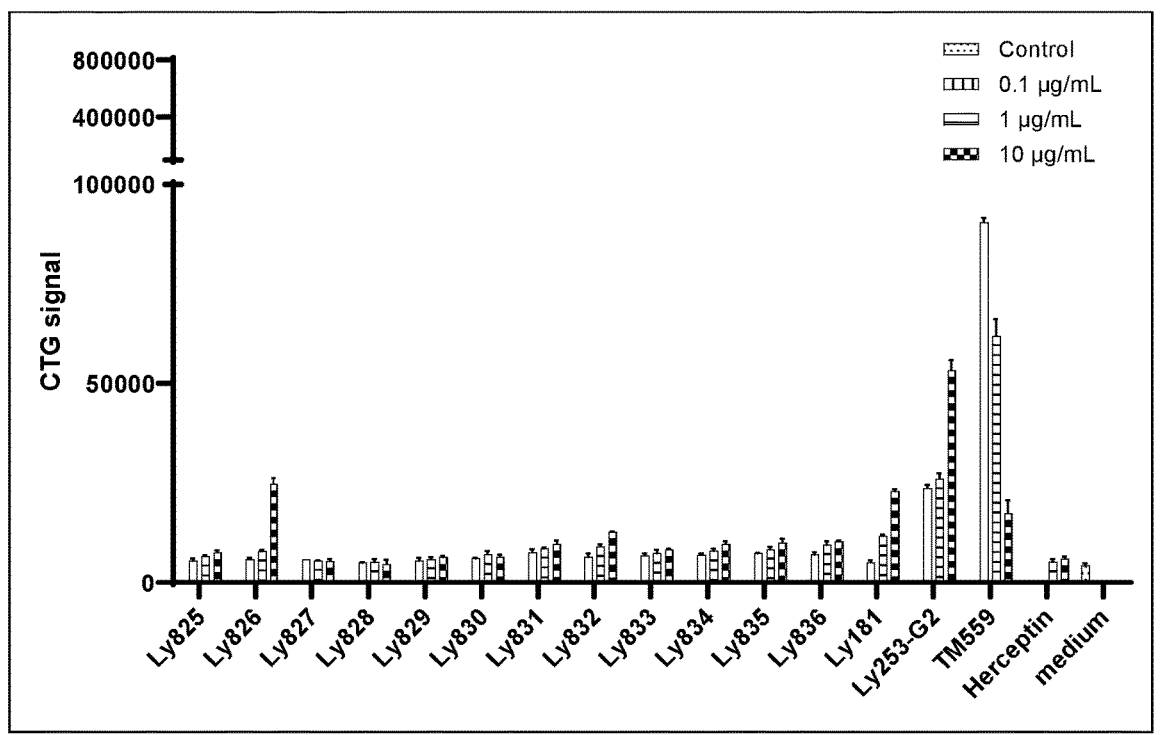

Anti-HER2/CD40 bispecific antibodies were evaluated for the activity to stimulate the proliferation of human B cells following the procedures disclosed in Example 3 above. As shown in FIGS. 52A and 52B, these bi-specific antibodies exhibited distinguished profile of B cells proliferation effect.

(iv) Anti-Tumor Activities

Exemplary anti-HER2/CD40 antibodies were tested in mouse syngeneic tumor models in vivo to determine the anti-tumor efficacy and toxicity of these antibodies. Human HER2 overexpressing murine colon cancer MC38 tumor cells were subcutaneously implanted into homozygous human CD40 knock-in C57BL/6 mice. Mice were grouped when the tumor size was approximately $150 \pm 50$ mm$^3$ (n=6). Anti-HER2/CD40 antibodies were administered by intraperitoneal injections and tumor sizes were measure during 4-6 weeks of antibody treatment. Tumor sizes were calculated as tumor volume using formula of 0.5×length×width$^2$. Anti-tumor efficacy was evaluated between tumor sizes of the control group and antibody treatment group as shown in FIG. 53. Antibody Ly253-G2 was used a reference, which showed antitumor efficacy while inducing serum ALT elevation. Several of the bispecific antibodies, for example, Ly619, Ly831 and Ly833 showed comparable or stronger efficacy relative to Ly253-G2 without inducing elevation of serum ALT.

OTHER EMBODIMENTS

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present invention, and without departing from the spirit and scope thereof, can make various changes and modifications of the invention to adapt it to various usages and conditions. Thus, other embodiments are also within the claims.

EQUIVALENTS

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

SEQUENCE LISTING (273 sequences)

SEQ ID NO: 1 - protein, 10 aa, Artificial Sequence
  Synthetic
GFNFNDSFMN

SEQ ID NO: 2 - protein, 10 aa, Artificial Sequence
  Synthetic
GFNFQDSFMN

SEQ ID NO: 3 - protein, 10 aa, Artificial Sequence
  Synthetic
GFNFNDAFMN

SEQ ID NO: 4 - protein, 10 aa, Artificial Sequence
  Synthetic
GFNFNDYFMN

SEQ ID NO: 5 - protein, 19 aa, Artificial Sequence
  Synthetic
QIRNKNYNYATYYTESLEG

SEQ ID NO: 6 - protein, 12 aa, Artificial Sequence
  Synthetic
YYYDGFADYFDY

SEQ ID NO: 7 - protein, 11 aa, Artificial Sequence
  Synthetic
KASQNIYIYLN

SEQ ID NO: 8 - protein, 7 aa, Artificial Sequence
  Synthetic
NTNNLQT

SEQ ID NO: 9 - protein, 8 aa, Artificial Sequence
  Synthetic
LQHSSRRT

SEQ ID NO: 10 - protein, 123 aa, Artificial Sequence
  Synthetic
EVQLVESGGGLVQPGGSLKLSCAASGFNFNDSFMNWVRQASGKGLEWVGQIRNKNYNYATYYTESLEGRFTISRDDSKNTAYLQMNSLKTEDTAVYYCTRYYYDGFADYFDYWGQGTTVTVSS

SEQ ID NO: 11 - protein, 123 aa, Artificial Sequence
  Synthetic
QVQLVESGGGLVQPGGSLKLSCATSGFNFNDSFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 12 - protein, 123 aa, Artificial Sequence
  Synthetic
QVQLVESGGGLVQPGGSLKLSCATSGFNFQDSFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 13 - protein, 123 aa, Artificial Sequence
  Synthetic
QVQLVESGGGLVQPGGSLKLSCATSGFNFNDAFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 14 - protein, 123 aa, Artificial Sequence
  Synthetic
QVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 15 - protein, 107 aa, Artificial Sequence
  Synthetic
DIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKR

SEQ ID NO: 16 - protein, 10 aa, Artificial Sequence
  Synthetic
GFTFTNYGLH

SEQ ID NO: 17 - protein, 17 aa, Artificial Sequence
  Synthetic
SISPSGGVTYYRDSVKG

SEQ ID NO: 18 - protein, 13 aa, Artificial Sequence
  Synthetic
PFLGWGGANWIAH

SEQ ID NO: 19 - protein, 11 aa, Artificial Sequence
  Synthetic
LASEDISNDLA

SEQ ID NO: 20 - protein, 7 aa, Artificial Sequence
  Synthetic
FVDRLLD

SEQ ID NO: 21 - protein, 9 aa, Artificial Sequence
  Synthetic
QQSYKYPPT

SEQ ID NO: 22 - protein, 122 aa, Artificial Sequence
  Synthetic
EVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 23 - protein, 108 aa, Artificial Sequence
  Synthetic
DIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKR

SEQ ID NO: 24 - protein, 10 aa, Artificial Sequence
  Synthetic
GYTFTDFWMS

SEQ ID NO: 25 - protein, 17 aa, Artificial Sequence
  Synthetic
QIYPNTGTTHSNEKFKG

SEQ ID NO: 26 - protein, 13 aa, Artificial Sequence
  Synthetic
SYHISTTPNWFAY

SEQ ID NO: 27 - protein, 11 aa, Artificial Sequence
  Synthetic
KASQNVYKKLE

SEQ ID NO: 28 - protein, 7 aa, Artificial Sequence
  Synthetic
HTNILQT

SEQ ID NO: 29 - protein, 8 aa, Artificial Sequence
  Synthetic
YQWNSGPT

SEQ ID NO: 30 - protein, 122 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSS

SEQ ID NO: 31 - protein, 107 aa, Artificial Sequence
  Synthetic
DIQMTQSPSSLSASVGDRVTITCKASQNVYKKLEWYQQKPGKVPKLLIYHTNILQTGVPSRFSGSGSGTDFTLTISSLQPEDVATYYCYQWNSGPTFGGGTKVEIKR

SEQ ID NO: 32 - protein, 107 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKR

SEQ ID NO: 33 - protein, 10 aa, Artificial Sequence
  Synthetic
GYTFTSYVMH

SEQ ID NO: 34 - protein, 16 aa, Artificial Sequence
  Synthetic
INPYNDGTECTDKFKG

SEQ ID NO: 35 - protein, 13 aa, Artificial Sequence
  Synthetic
SIYYGYDGTYFGV

SEQ ID NO: 36 - protein, 10 aa, Artificial Sequence
  Synthetic
GYTFTSYWMH

SEQ ID NO: 37 - protein, 17 aa, Artificial Sequence
  Synthetic
MIHPNSGGTNYNEKFKG

SEQ ID NO: 38 - protein, 8 aa, Artificial Sequence
  Synthetic
SQATWFAY

SEQ ID NO: 39 - protein, 10 aa, Artificial Sequence
  Synthetic
RASSSVSYMH

SEQ ID NO: 40 - protein, 6 aa, Artificial Sequence
  Synthetic
TSNLAS

SEQ ID NO: 41 - protein, 9 aa, Artificial Sequence
  Synthetic
QQWSSNTLT

SEQ ID NO: 42 - protein, 12 aa, Artificial Sequence
  Synthetic
RASSSVSSSYLH

SEQ ID NO: 43 - protein, 7 aa, Artificial Sequence
  Synthetic
STSNLAS

SEQ ID NO: 44 - protein, 9 aa, Artificial Sequence
  Synthetic
QHYSGYPLT

SEQ ID NO: 45 - protein, 121 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSS

SEQ ID NO: 46 - protein, 106 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELK

SEQ ID NO: 47 - protein, 117 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSA

SEQ ID NO: 48 - protein, 108 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELR

SEQ ID NO: 49 - protein, 10 aa, Artificial Sequence
  Synthetic
GFTFSSYGMS

SEQ ID NO: 50 - protein, 17 aa, Artificial Sequence
  Synthetic
AISTGGSYTYYPDSVKG

SEQ ID NO: 51 - protein, 10 aa, Artificial Sequence
  Synthetic
RGATGSWFAY

SEQ ID NO: 52 - protein, 10 aa, Artificial Sequence
  Synthetic
GFTFSDSGMH

SEQ ID NO: 53 - protein, 17 aa, Artificial Sequence
  Synthetic
YINSGSSTIYYADSVKG

SEQ ID NO: 54 - protein, 8 aa, Artificial Sequence
  Synthetic
GRGYAMDY

SEQ ID NO: 55 - protein, 11 aa, Artificial Sequence
  Synthetic
HASQGINNNIG

SEQ ID NO: 56 - protein, 6 aa, Artificial Sequence
  Synthetic
GTNLED

SEQ ID NO: 57 - protein, 9 aa, Artificial Sequence
  Synthetic
VQYVQFPRT

SEQ ID NO: 58 - protein, 12 aa, Artificial Sequence
  Synthetic
SASSSISSDFLH

SEQ ID NO: 59 - protein, 7 aa, Artificial Sequence
  Synthetic
RISNLAS

SEQ ID NO: 60 - protein, 9 aa, Artificial Sequence
  Synthetic
QQGSNVPRT

SEQ ID NO: 61 - protein, 119 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSA

SEQ ID NO: 62 - protein, 108 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKR

SEQ ID NO: 63 - protein, 117 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSS

SEQ ID NO: 64 - protein, 109 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKR

SEQ ID NO: 65 - protein, 5 aa, Artificial Sequence
  Synthetic
GGGGS

SEQ ID NO: 66 - protein, 10 aa, Artificial Sequence
  Synthetic
GGGGSGGGGS

SEQ ID NO: 67 - protein, 15 aa, Artificial Sequence
  Synthetic
GGGGSGGGGSGGGGS

SEQ ID NO: 68 - protein, 20 aa, Artificial Sequence
  Synthetic
GGGGSGGGGSGGGGSGGGGS

SEQ ID NO: 69 - protein, 25 aa, Artificial Sequence
  Synthetic
GGGGSGGGGSGGGGSGGGGSGGGGS

SEQ ID NO: 70 - protein, 30 aa, Artificial Sequence
  Synthetic
GGGGSGGGGSGGGGSGGGGSGGGGSGGGGS

SEQ ID NO: 71 - protein, 123 aa, Artificial Sequence
  Synthetic
EVQILETGGGLVKPGGSLRLSCATSGFNFNDSFMNWVRQAPGKGLEWVAQIRNKNYNYATYYTESLEGRVTISRDDSKSRVYLQVSSLRAEDSAVYYCTSYYYDGFADYFDYWGQGVMVTVSS

SEQ ID NO: 72 - protein, 107 aa, Artificial Sequence
  Synthetic
DIKMTQSPSFLSASVGDSVTFTCKASQNIYIYLNWYQQKFGEAPKLLIYNTNNLQTGIPSRFSGSESGTVFTLTISSLQPEDVATYFCLQHSSRRTFGGGTKLELKR

SEQ ID NO: 73 - protein, 123 aa, Homo sapiens
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRLVADGGWYGMDVWGQGTTVTVSS

SEQ ID NO: 74 - protein, 138 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGGGTKVEIKRTVAAPSVFIFPPSDEQLKSGTASVVCLLNN

SEQ ID NO: 75 - protein, 218 aa, Artificial Sequence
  Synthetic
EVQLLESGGGLVQPGGSLRLSCAASGFTFSTFSMNWVRQAPGKGLEWVSYISRTSKTIYYADSVKGRFTISRDNSKNTLYLQMNSLRAEDTAVYYCARGRFFDYWGQGTLVTVSIQMTQSPSSLSASVGDRVTITCRASQSISSYLNWYQQKPGEAPKLLIYSASVLQSGVPSRFSGSGSGTDFTLTISSLQPEDFATYYCQQSVMIPMTFGQGTKVE

SEQ ID NO: 76 - protein, 449 aa, Artificial Sequence
  Synthetic
EVQILETGGGLVKPGGSLRLSCATSGFNFNDSFMNWVRQAPGKGLEWVAQIRNKNYNYATYYTESLEGRVTISRDDSKSRVYLQVSSLRAEDSAVYYCTSYYYDGFADYFDYWGQGVMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 77 - protein, 213 aa, Artificial Sequence
  Synthetic
DIKMTQSPSFLSASVGDSVTFTCKASQNIYIYLNWYQQKFGEAPKLLIYNTNNLQTGIPSRFSGSESGTVFTLTISSLQPEDVATYFCLQHSSRRTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 448 aa, Artificial Sequence
  Synthetic
EVQLVESGGGLVQPGGSLKLSCAASGFNFNDSFMNWVRQASGKGLEWVGQIRNKNYNYATYYTESLEGRFTISRDDSKNTAYLQMNSLKTEDTAVYYCTRYYYDGFADYFDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 79 - protein, 448 aa, Artificial Sequence
  Synthetic
QVQLVESGGGLVQPGGSLKLSCATSGFNFNDSFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 80 - protein, 452 aa, Artificial Sequence
  Synthetic
QVQLVESGGGLVQPGGSLKLSCATSGFNFNDSFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPSSKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKA

SEQ ID NO: 81 - protein, 449 aa, Artificial Sequence
  Synthetic
QVQLVESGGGLVQPGGSLKLSCATSGFNFNDSFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 82 - protein, 451 aa, Artificial Sequence
  Synthetic
QVQLVESGGGLVQPGGSLKLSCATSGFNFNDSFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 83 - protein, 451 aa, Artificial Sequence
  Synthetic
QVQLVESGGGLVQPGGSLKLSCATSGFNFQDSFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 84 - protein, 451 aa, Artificial Sequence
  Synthetic
QVQLVESGGGLVQPGGSLKLSCATSGFNFNDAFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 85 - protein, 451 aa, Artificial Sequence
  Synthetic
QVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 86 - protein, 448 aa, Artificial Sequence
  Synthetic
QVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 87 - protein, 213 aa, Artificial Sequence
  Synthetic
DIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 122 aa, Artificial Sequence
  Synthetic
EVHLVESGGGLVQPGRSLKLSCAASGFTFTNYGLHWIRQAPTKGLEWVASISPSGGVTYYRDSVKGRFTISRDNGKTTLHLQMDSLRSEDTATYYCALPFLGWGGANWIAHWGQGTLVTVSS

SEQ ID NO: 89 - protein, 108 aa, Artificial Sequence
  Synthetic
DIQMTQSPASLSASLGETVSIECLASEDISNDLAWYQQKSGKSPQLLIYFVDRLLDGVPSRFSGSGSGTRHSLKISGMQPEDEADYFCQQSYKYPPTFGGGTKLELKR

SEQ ID NO: 90 - protein, 118 aa, Homo sapiens
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKRPTLGATGYWGQGTLVTVSS

SEQ ID NO: 91 - protein, 110 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPRTFGQGTKLEIKRT

SEQ ID NO: 92 - protein, 448 aa, Artificial Sequence
  Synthetic
EVHLVESGGGLVQPGRSLKLSCAASGFTFTNYGLHWIRQAPTKGLEWVASISPSGGVTYYRDSVKGRFTISRDNGKTTLHLQMDSLRSEDTATYYCALPFLGWGGANWIAHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 93 - protein, 214 aa, Artificial Sequence
  Synthetic
DIQMTQSPASLSASLGETVSIECLASEDISNDLAWYQQKSGKSPQLLIYFVDRLLDGVPSRFSGSGSGTRHSLKISGMQPEDEADYFCQQSYKYPPTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 447 aa, Artificial Sequence
  Synthetic
EVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 95 - protein, 451 aa, Artificial Sequence
  Synthetic
EVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 96 - protein, 448 aa, Artificial Sequence
  Synthetic
EVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 97 - protein, 450 aa, Artificial Sequence
  Synthetic
EVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVEHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 98 - protein, 214 aa, Artificial Sequence
  Synthetic
DIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 452 aa, Artificial Sequence
  Synthetic
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 100 - protein, 451 aa, Artificial Sequence
  Synthetic
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 101 - protein, 214 aa, Artificial Sequence
  Synthetic
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 122 aa, Artificial Sequence
  Synthetic
QVKLLQSGAALVKPGASVKMSCKTSGYTFTDFWMSWVKQSHGKSLEWVGQIYPNTGTTHSNEKFKGKATLTVDKSTSTAYLELSRLTSEDSAIYYCSRSYHISTTPNWFAYWGQGTLVTVSS

SEQ ID NO: 103 - protein, 107 aa, Artificial Sequence
  Synthetic
DIQMTQAPSLLSASVGDRVTLNCKASQNVYKKLEWYQQKHGEAPKVVIHHTNILQTGISSRFSGSGSGTDYTLTISSLQSEDVATYYCYQWNSGPTFGAGTKLELKR

SEQ ID NO: 104 - protein, 224 aa, Artificial Sequence
  Synthetic
DIQMTQTTSSLSASLGDRVTISCRASQDINNYLNWYQQKPDGTVKLLIHYTSRLHSGVPSRFSGSGSGTDYSLTISNLEQEDIATYFCQQGNTLPWTFGGGTKLEIKQVQLQQPGAELVKPGTSVKLSCKASGYNFTSYWINWVKLRPGQGLEWIGDIYPGSGITNYNEKFKSKATLTVDTSSSTAYMQLSSLASEDSALYYCAGQYGNLWFAYWGQGTLVTVS

SEQ ID NO: 105 - protein, 452 aa, Artificial Sequence
  Synthetic
QVKLLQSGAALVKPGASVKMSCKTSGYTFTDFWMSWVKQSHGKSLEWVGQIYPNTGTTHSNEKFKGKATLTVDKSTSTAYLELSRLTSEDSAIYYCSRSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 213 aa, Artificial Sequence
  Synthetic
DIQMTQAPSLLSASVGDRVTLNCKASQNVYKKLEWYQQKHGEAPKVVIHHTNILQTGISSRFSGSGSGTDYTLTISSLQSEDVATYYCYQWNSGPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 213 aa, Artificial Sequence
  Synthetic
DIQMTQSPSSLSASVGDRVTITCKASQNVYKKLEWYQQKPGKVPKLLIYHTNILQTGVPSRFSGSGSGTDFTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 213 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 452 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 719 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 111 - protein, 719 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 112 - protein, 450 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 113 - protein, 482 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 114 - protein, 482 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 115 - protein, 719 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 116 - protein, 719 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 117 - protein, 482 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 118 - protein, 482 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 119 - protein, 723 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 120 - protein, 723 aa, Artificial Sequence
  Synthetic
QVQLVQSGAEVKKPGASVKVSCKASGYTFTDFWMSWVRQAPGQGLEWMGQIYPNTGTTHSNEKFKGRVTMTRDTSTSTVYMELSSLRSEDTAVYYCARSYHISTTPNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 121 - protein, 486 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 122 - protein, 486 aa, Artificial Sequence
  Synthetic
DIQMTQSPSSLSASVGDRVTITCKASQNVYKKLEWYQQKPGKVPKVLIYHTNILQTGVPSRFSGSGSGTDYTLTISSLQPEDVATYYCYQWNSGPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 123 - protein, 449 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 214 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 447 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 215 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 716 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 128 - protein, 716 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 129 - protein, 716 aa, Artificial Sequence; identical to SEQ ID NO: 128
  Synthetic

SEQ ID NO: 130 - protein, 483 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 131 - protein, 483 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 132 - protein, 716 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 133 - protein, 716 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 134 - protein, 483 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 135 - protein, 483 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 136 - protein, 720 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 137 - protein, 720 aa, Artificial Sequence
  Synthetic
EVQLVESGGDLVKPGGSLKLSCAASGFTFSSYGMSWVRQTPDKRLEWVAAISTGGSYTYYPDSVKGRFTISRDTATNTLYLQMSTLKSEDTAMYYCTRRGATGSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 138 - protein, 487 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 139 - protein, 487 aa, Artificial Sequence
  Synthetic
DILMTQSPSSMSVSLGDTVSITCHASQGINNNIGWLQRKPGKSFKGLIYHGTNLEDGVPSRFSGSGSGADYSLTISSLESEDFADYYCVQYVQFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 140 - protein, 714 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 141 - protein, 714 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 142 - protein, 446 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 484 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 144 - protein, 484 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 145 - protein, 714 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 146 - protein, 714 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 147 - protein, 484 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 148 - protein, 484 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 149 - protein, 718 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 150 - protein, 718 aa, Artificial Sequence
  Synthetic
EVQLVESGGGLVKPGGSLKLSCAASGFTFSDSGMHWVRQAPEKGLEWITYINSGSSTIYYADSVKGRFTISRDNAKNTLFLQMTSLRSEDTAMYYCARGRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 151 - protein, 488 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 152 - protein, 488 aa, Artificial Sequence
  Synthetic
EIVLTQSPTTMAASPGEKITIFCSASSSISSDFLHWYQQKPGFSPKLLIYRISNLASGVPARFSGSGSGTSYSLTIGTMEAEDVATYYCQQGSNVPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 153 - protein, 449 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 213 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 155 - protein, 451 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 218 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 157 - protein, 716 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 158 - protein, 716 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 159 - protein, 448 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 482 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 161 - protein, 482 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 162 - protein, 718 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 163 - protein, 718 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 164 - protein, 450 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 487 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 166 - protein, 487 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 167 - protein, 716 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 168 - protein, 716 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 169 - protein, 482 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 170 - protein, 482 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 171 - protein, 718 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 172 - protein, 718 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 173 - protein, 487 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 174 - protein, 487 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 175 - protein, 720 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 176 - protein, 720 aa, Artificial Sequence
  Synthetic
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 177 - protein, 486 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 178 - protein, 486 aa, Artificial Sequence
  Synthetic
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 179 - protein, 722 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 180 - protein, 722 aa, Artificial Sequence
  Synthetic
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 181 - protein, 491 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 182 - protein, 491 aa, Artificial Sequence
  Synthetic
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 183 - protein, 448 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 184 - protein, 215 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 717 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 186 - protein, 717 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 187 - protein, 484 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 188 - protein, 484 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 189 - protein, 717 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 190 - protein, 717 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 191 - protein, 484 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 192 - protein, 484 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 193 - protein, 721 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 194 - protein, 721 aa, Artificial Sequence
  Synthetic
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 195 - protein, 488 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 196 - protein, 488 aa, Artificial Sequence
  Synthetic
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 197 - protein, 451 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 213 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 447 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 215 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 201 - protein, 718 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 202 - protein, 718 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 203 - protein, 718 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 204 - protein, 718 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 205 - protein, 714 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 206 - protein, 714 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 207 - protein, 714 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 208 - protein, 714 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 209 - protein, 449 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 482 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 211 - protein, 482 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 212 - protein, 482 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 213 - protein, 482 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 214 - protein, 445 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 215 - protein, 484 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 216 - protein, 484 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 217 - protein, 484 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 218 - protein, 484 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 219 - protein, 722 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 220 - protein, 722 aa, Artificial Sequence
  Synthetic
EVQLQQSGPELVKPGASVKMSCKASGYTFTSYVMHWVKQKPGQGLEWIGYINPYNDGTECTDKFKGKATLTSDKSSSTAYMELSSLTSEDSAVYYCASIYYGYDGTYFGVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 221 - protein, 486 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 222 - protein, 486 aa, Artificial Sequence
  Synthetic
QIVLSQSPAILSTSPGEKVTMTCRASSSVSYMHWYQQKPGSSPKPWIYATSNLASGVPARFSGSRSGTSYSLTISRVEAEDAATYYCQQWSSNTLTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 223 - protein, 718 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 224 - protein, 718 aa, Artificial Sequence
  Synthetic
QVQLQQPGAELVKPGASVKLSCKASGYTFTSYWMHWVKQRPGQGLEWIGMIHPNSGGTNYNEKFKGKGTLTVDKSSSTAYMQLSSLTSDDSAVYYCVTSQATWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 225 - protein, 488 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 226 - protein, 488 aa, Artificial Sequence
  Synthetic
ENVLTQSPAIMSVSPGEKVTMTCRASSSVSSSYLHWYQQKSGASPKFWIYSTSNLASGVPARFSGSGSGTSYSLTISSVEAEDAATYYCQHYSGYPLTFGAGTKLELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 227 - protein, 448 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 228 - protein, 213 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 229 - protein, 722 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 230 - protein, 722 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 231 - protein, 450 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 486 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 233 - protein, 486 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 234 - protein, 718 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 235 - protein, 718 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 236 - protein, 482 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 237 - protein, 482 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 238 - protein, 718 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 239 - protein, 718 aa, Artificial Sequence
  Synthetic
QVTLKESGPALVKPTQTLTLTCTFSGFSLSTSGTCVSWIRQPPGKALEWLATICWEDSKGYNPSLKSRLTISKDTSKNQAVLTMTNMDPVDTATYYCARREDSGYFWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 240 - protein, 482 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 241 - protein, 482 aa, Artificial Sequence
  Synthetic
NIQMTQSPSSLSASVGDRVTITCKAGQNVNNYLAWYQQKPGKAPKVLIFNANSLQTGVPSRFSGSGSGTDFTLTISSLQPEDFATYYCQQYNSWPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 242 - protein, 450 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 214 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 244 - protein, 449 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - protein, 214 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 246 - protein, 717 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 247 - protein, 717 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 248 - protein, 448 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 249 - protein, 483 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 250 - protein, 483 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 251 - protein, 717 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 252 - protein, 717 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 253 - protein, 483 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 254 - protein, 483 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 255 - protein, 716 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 256 - protein, 716 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 257 - protein, 447 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 258 - protein, 483 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIKGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSS

SEQ ID NO: 259 - protein, 483 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVESGGGLVQPGGSLKLSCATSGFNFNDYFMNWVRQASGKGLEWVGQIRNKNYNYATYYTESLEGRVTISRDDSKNTAYLQMNSLKTEDTAVYYCTSYYYDGFADYFDYWGQGTTVTVSSGGGGSGGGGSGGGGSGGGGSDIQMTQSPSSLSASVGDRVTITCKASQNIYIYLNWYQQKPGKAPKLLIYNTNNLQTGVPSRFSGSGSGTDFTLTISSLQPEDFATYYCLQHSSRRTFGGGTKVEIK

SEQ ID NO: 260 - protein, 716 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 261 - protein, 716 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 262 - protein, 483 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIKGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSS

SEQ ID NO: 263 - protein, 483 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGFTFTNYGLHWVRQAPGKGLEWVSSISPSGGVTYYRDSVKGRFTISRDNSKNTLYLQMNSLRAEDTAVYYCAKPFLGWGGANWIAHWGQGTLVTVSSGGGGSGGGGSGGGGSGGGGSDIQMTQSPSSLSASVGDRVTITCLASEDISNDLAWYQQKPGKAPKLLIYFVDRLLDGVPSRFSGSGSGTDFTLTISSLQPEDFATYYCQQSYKYPPTFGQGTKLEIK

SEQ ID NO: 264 - protein, 721 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 265 - protein, 721 aa, Artificial Sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 266 - protein, 487 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 267 - protein, 487 aa, Artificial Sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 268 - protein, 720 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 269 - protein, 720 aa, Artificial Sequence
  Synthetic
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 270 - protein, 487 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 271 - protein, 487 aa, Artificial Sequence
  Synthetic
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSQVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSGGGGSGGGGSGGGGSGGGGSDIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 272 - protein, 5 aa, Artificial Sequence
  Synthetic
SGGGS

SEQ ID NO: 273 - protein, 229 aa, Artificial Sequence
  Synthetic
DIQMTQAPSLLSASVGDRVTLNCKASQNVYKKLEWYQQKHGEAPKVVIHHTNILQTGISSRFSGSGSGTDYTLTISSLQSEDVATYYCYQWNSGPTFGAGTKLELKRQVKLLQSGAALVKPGASVKMSCKTSGYTFTDFWMSWVKQSHGKSLEWVGQIYPNTGTTHSNEKFKGKATLTVDKSTSTAYLELSRLTSEDSAIYYCSRSYHISTTPNWFAYWGQGTLVTVSS

What is claimed is:

1. A humanized antibody specific to human CD40, wherein the humanized antibody comprises a heavy chain variable region ($V_H$) and a light chain variable region ($V_L$), wherein:

(i) the $V_H$ comprises a framework of IGHV3-73*01 and heavy chain complementary determining regions (CDRs) 1, 2, and 3, and the $V_L$ comprises a framework of IGKV1-39*01 and light chain CDRs 1, 2, and 3; wherein the $V_H$ comprises the heavy chain CDR1 comprising the amino acid sequence of GFNFNDSFMN (SEQ ID NO:1), GENFQDSFMN (SEQ ID NO:2), GENFNDAFMN (SEQ ID NO: 3), or GENENDYFMN (SEQ ID NO:4), the heavy chain CDR2 comprising the amino acid sequence of QIRNKNYNYATYYTESLEG (SEQ ID NO:5), and the heavy chain CDR3 comprising the amino acid sequence of YYYDGFADYFDY (SEQ ID NO:6); and the $V_L$ comprises the light chain CDR1, light chain CDR2, and light chain CDRs comprising the amino acid sequences of KASQNIYIYLN (SEQ ID NO:7), NTNNLOT (SEQ ID NO:8), and LOHSSRRT (SEQ ID NO:9), respectively; or (ii) the $V_H$ comprises a framework of IGHV3-23*04 and heavy chain CDRs 1, 2, and 3, and the $V_L$ comprises a framework of IGKV1-39*01 and light chain CDRs 1, 2, and 3; wherein:

the $V_H$ comprises the heavy chain CDR1, the heavy chain CDR2, and the heavy chain CDR3 comprising the amino acid sequences of GFTFTNYGLH (SEQ ID NO:16), SISPSGGVTYYRDSVKG (SEQ ID NO:17), and PFLGWGGANWIAH (SEQ ID NO:18) respectively; and the $V_L$ comprises the light chain CDR1, the light chain CDR2, and the light chain CDR3 comprising the amino acid sequences of LASEDISNDLA (SEQ ID NO:19), FVDRLLD (SEQ ID NO:20), and QQSYKYPPT (SEQ ID NO:21), respectively.

2. The humanized antibody of claim 1, wherein the humanized antibody is set forth in (i).

3. The humanized antibody of claim 2, wherein the $V_H$ comprises one or more mutations in the $V_H$ framework.

4. The humanized antibody of claim 3, wherein the mutations in the $V_H$ framework are back mutations based on amino acid residues in the parent murine antibody at corresponding positions.

5. The humanized antibody of claim 4, wherein the back mutations comprise E1Q, A24T, F70V, R100S, or a combination thereof.

6. The humanized antibody of claim 2, wherein the $V_H$ comprises the amino acid sequence of any one of SEQ ID NOs: 10-14 and the $V_L$ comprises the amino acid sequence of SEQ ID NO:15.

7. The humanized antibody of claim 1, wherein the antibody is set forth in (ii).

8. The humanized antibody of claim 7, wherein the $V_H$ comprises the amino acid sequence of SEQ ID NO:22; and wherein the $V_L$ comprises the amino acid sequence of SEQ ID NO:23.

9. The humanized antibody of claim 1, wherein the humanized antibody is a full-length antibody.

10. The humanized antibody of claim 9, wherein the full-length antibody is an IgG/kappa molecule.

11. The humanized antibody of claim 10, wherein the full-length antibody comprises a heavy chain that is an IgG1, IgG2, or IgG4 chain.

12. The humanized antibody of claim 11, wherein the heavy chain comprises a mutated Fc region, which exhibits altered binding affinity or selectivity to an Fc receptor as relative to the wild-type counterpart.

13. The humanized antibody of claim 10, wherein the humanized antibody is selected from the group consisting of TM550, TM553, LP3771, LP3772, LP3773, TM738, TM739, TM740, and Ly181; or wherein the antibody is selected from the group consisting of TM559, LP3781, LP3782, and LP3783.

14. A bi-specific antibody, comprising:

(a) a first antibody moiety that binds human CD40, which is set forth in claim 1; and (b) a second antibody moiety that binds an antigen selected from the group consisting of HER2, necrotic tumor cells (TNT), carcinoembryonic antigen (CEA), PD-1, PD-L1, B7H3, and B7H4.

15. The bi-specific antibody of claim 14, wherein either the first antibody moiety or the second antibody moiety is in a single-chain antibody (scFv) format; and wherein the other antibody moiety is in a full-length antibody format comprising a heavy chain and a light chain.

16. The bi-specific antibody of claim 15, wherein the first antibody moiety that binds human CD40 is a scFv; wherein the second antibody moiety comprises a first polypeptide comprising an antibody heavy chain and a second polypeptide comprising an antibody light chain, and wherein the scFv is fused to either the first polypeptide or the second polypeptide.

17. The bi-specific antibody of claim 14, which is selected from the group consisting of Ly301, Ly303, Ly338, Ly339, Ly340, Ly341, Ly342, Ly343, Ly344, Ly345, Ly349, and Ly350;

which is selected from the group consisting of Ly610, Ly611, Ly612, Ly613, Ly614, Ly615, Ly616, Ly617, Ly801, Ly802, Ly803, Ly804, Ly805, Ly806, Ly807, Ly808, Ly809, Ly810, Ly811, Ly812, Ly813, Ly814, Ly815, and Ly816;

which is selected from the group consisting of Ly474, Ly475, Ly476, Ly477, Ly478, Ly479, Ly480, Ly481, Ly482, Ly483, Ly484, Ly485, Ly486, Ly487, Ly488, Ly489, Ly490, Ly491, Ly492, Ly493, Ly494, Ly495, Ly496, and Ly497;

which is selected from the group consisting of Ly401, Ly402, Ly403, Ly404, Ly405, Ly406, Ly407, Ly408, Ly409, Ly410, Ly411, Ly412, Ly413, Ly414, Ly415, Ly416, Ly417, Ly418, Ly419, Ly420, Ly421, Ly422, Ly423, and Ly424;

which is selected from the group consisting of Ly462, Ly463, Ly464, Ly465, Ly466, Ly467, Ly468, Ly469, Ly470, Ly471, Ly472, and Ly473;

which is selected from the group consisting of Ly517, Ly518, Ly519, Ly520, Ly606, Ly607, Ly608, Ly609, Ly817, Ly818, Ly819, and Ly820; or which is selected from the group consisting of Ly618, Ly619, Ly620, Ly621, Ly622, Ly623, Ly624, Ly625, Ly821, Ly822, Ly823, Ly824, Ly825, Ly826, Ly827, Ly828, Ly829, Ly830, Ly831, Ly832, Ly833, Ly834, Ly835, and Ly836.

18. A nucleic acid or a nucleic acid set, which collectively encodes an antibody specific to human CD40, wherein the antibody is set forth in claim 1.

19. A host cell, comprising the nucleic acid or nucleic acid set of claim 18.

20. A method for producing a humanized antibody, comprising:

(i) culturing the host cell of claim 19 under conditions allowing for expression of the humanized antibody; and (ii) harvesting the humanized antibody thus produced.

21. A pharmaceutical composition comprising an antibody of claim 1 and a pharmaceutically acceptable carrier.

22. A method for modulating immune responses, comprising administering an effective amount of the humanized antibody of claim 1 or the pharmaceutical composition thereof to a subject in need thereof.

* * * * *